US006943241B2

(12) United States Patent
Isogai et al.

(10) Patent No.: US 6,943,241 B2
(45) Date of Patent: Sep. 13, 2005

(54) FULL-LENGTH CDNA

(75) Inventors: Takao Isogai, Ibaraki (JP); Tomoyasu Sugiyama, Tokyo (JP); Tetsuji Otsuki, Chiba (JP); Ai Wakamatsu, Chiba (JP); Hiroyuki Sato, Osaka (JP); Shizuko Ishii, Chiba (JP); Jun-ichi Yamamoto, Chiba (JP); Yuuko Isono, Chiba (JP); Yuri Hio, Chiba (JP); Kaoru Otsuka, Saitama (JP); Keiichi Nagai, Tokyo (JP); Ryotaro Irie, Chiba (JP); Ichiro Tamechika, Osaka (JP); Naohiko Seki, Chiba (JP); Tsutomu Yoshikawa, Chiba (JP); Motoyuki Otsuka, Tokyo (JP); Kenji Nagahari, Tokyo (JP); Yasuhiko Masuho, Tokyo (JP)

(73) Assignee: Research Association for Biotechnology, Tokyo (JP)

( * ) Notice: Subject to any disclaimer, the term of this patent is extended or adjusted under 35 U.S.C. 154(b) by 232 days.

(21) Appl. No.: 10/104,047

(22) Filed: Mar. 25, 2002

(65) Prior Publication Data

US 2003/0236392 A1 Dec. 25, 2003

Related U.S. Application Data

(60) Provisional application No. 60/350,978, filed on Jan. 25, 2002.

(30) Foreign Application Priority Data

Nov. 5, 2001 (JP) ........................................ 2001-379298

(51) Int. Cl.$^7$ ........................ C07H 21/04; C07K 14/00; C12N 15/63; C12N 15/85; C12N 15/86
(52) U.S. Cl. ..................... 536/23.1; 536/24.3; 530/350; 435/252.1; 435/320.1
(58) Field of Search .............................. 536/23.1, 24.3; 530/350; 435/252.1, 320.1

(56) References Cited

FOREIGN PATENT DOCUMENTS

| EP | 0473253 A1 * | 4/1992 | ........... C12N/15/85 |
|---|---|---|---|
| EP | 0866126 A1 | 9/1998 | |
| EP | 1026242 A1 | 8/2000 | |
| EP | 1195434 A1 | 4/2002 | |
| WO | WO 98/21328 A2 | 5/1998 | |
| WO | WO 98/29437 A2 | 7/1998 | |
| WO | WO 98/40485 A1 | 9/1998 | |
| WO | WO 98/46749 A1 | 10/1998 | |
| WO | WO 01/07607 A2 | 2/2001 | |

OTHER PUBLICATIONS

Skolnick, J and Fetrow, J. "From genes to protein strcutre and function: novel applications of computations approaches in the genomic era" TIBTECH, (2000), vol. 18, pp. 34–39.*
Fetrow, J. et al. "Functional Analysis of the *E. coli* Genome Using the Sequence–to–Structure–to–Function Paradigm: Identification of Proteins Exhibiting the Glutaredoxin/Thioredoxin Disulfide Oxidoreductase Activity" J. Mol. Biol. (1998) v 282, pp. 703–711.*

GenBank Accession No.: AC02475.*
Alignment between SEQ ID No. 397 and GenBank Accession NO AC02475.*
Alignment between 15 oligonucelotide fragment of SEQ ID No. 397 and nucleic acid sequence (CM8 DNA) from EP0473253A1.*
Masato Taoka et al., "Murine Cerebellar Neurons Express a Novel Gene Encoding a Protein Related to Cell Cycle Control and Cell Fate Determination Proteins*", The Journal of Biological Chemistry, Apr. 1, 1994, pp. 9946–9951, vol. 269, No. 13.
Natarajan Sivasubramanian et al., "Cardiac Myotrophin Exhibits rel/NF–κB Interacting Activity *in Vitro*\*", The Journal of Biological Chemistry, Feb. 2, 1996, pp. 2812–2816, vol. 271, No. 5.
Masato Taoka, et al., "A rat cerebellar protein containing the cdc 10/SWI6 motif", Eur. J. Biochem, 1992, pp. 615–620, vol. 207, No. 2.
Diane Pennica et al., "Isolation of cDNA clones encoding the mouse protein V–1*", Gene, 1995, pp. 305–306, vol. 158, No. 2.
The Fantom Consortium and the Riken Genome Exploration Research Group Phase I and II Team, "Analysis of the mouse transcriptome based on functional annotation of 60,770 full–length cDNAs", Nature, Dec. 5, 2002, pp. 563–573, vol. 420, No. 6915.
Yanwu Yang, et al., "Nuclear magnetic resonance assignment and secondary structure of an ankyrin–like repeatbearing protein: Myotrophin", Protein Science, 1997, pp. 1347–1351, vol. 6, No. 6.
Yanwu Yang, et al., "The structural basis of ankyrin–like repeat function as revealed by the solution structure of myotrophin", Structure, 1999, pp. 619–626, vol. 6, No. 5.
S. Sugano et al., Tanpakushitsu Kakusan Koso (Protein, Nucleic Acid and Enzyme), vol. 38, No. 3, pp. 476–481 (1993) English language abstract attached, abstract only.
Hemology Search Result Data (hemology search result of the clones disclosed in present application) pp. 1–63, Aug. 8, 2001.
EMBL Accession No. BC001382, XP–002229929.
Mark Griffiths et al., "Cloning of a human nucleoside transporter implicated in the cellular uptake of adenosine and chemotherapeutic drugs," Nature Medicine, Jan. 1997, pp. 89–93, vol. 3, No. 1.
Homology Search Result Data (homology search result of the clones disclosed in present application) pp. 1–63, Aug. 8, 2001.

\* cited by examiner

Primary Examiner—Jehanne Sitton
Assistant Examiner—Sarae Bausch
(74) Attorney, Agent, or Firm—Foley & Lardner LLP

(57) ABSTRACT

Novel full-length cDNAs are provided. 1970 cDNA derived from human have been isolated. The full-length nucleotide sequences of the cDNA and amino acid sequences encoded by the nucleotide sequences have been determined. Because the cDNA of the present invention are full-length and contain the translation start site, they provide information useful for analyzing the functions of the polypeptide.

4 Claims, 1 Drawing Sheet

FULL-LENGTH CDNA

FIELD OF THE INVENTION

The present invention relates to polynucleotides encoding novel polypeptides, polypeptides encoded by the polynucleotides, and new uses of these.

BACKGROUND OF THE INVENTION

Currently, the sequencing projects, the determination and analysis of the genomic DNA of various living organisms have been in progress all over the world. The whole genomic sequences of more than 40 species of prokaryotes, a lower eukaryote, yeast, a multicellular eukaryote, C. elegans, and a higher plants, *arabidopsis*, etc. are already determined. For human genome, presumably having 3 billion base pairs, the analysis was advanced under global cooperative organization, and a draft sequence was disclosed in 2001. Moreover, all the structures are to be clear and to be disclosed in 2002–2003. The aim of the determination of genomic sequence is to reveal the functions of all genes and their regulation and to understand living organisms as a network of interactions between genes, proteins, cells or individuals through deducing the information in a genome, which is a blueprint of the highly complicated living organisms. To understand living organisms by utilizing the genomic information from various species is not only important as an academic subject, but also socially significant from the viewpoint of industrial application.

However, determination of genomic sequences itself cannot identify the functions of all genes. For example, as for yeast, only the function of approximately half of the 6000 genes, which is predicted based on the genomic sequence, was able to be deduced. On the other hand, the human genome has been estimated to contain about 30,000–40,000 genes. Further, 100,000 or more types of mRNAs are said to exist when variants produced by alternative splicing are taken into consideration. Therefore, it is desirable to establish "a high throughput analysis system of the gene functions" which allows us to identify rapidly and efficiently the functions of vast amounts of the genes obtained by the genomic sequencing.

Many genes in the eukaryotic genome are split by introns into multiple exons. Thus, it is difficult to predict correctly the structure of encoded protein solely based on genomic information. In contrast, cDNA, which is produced from mRNA that lacks introns, encodes a protein as a single continuous amino acid sequence and allows us to identify the primary structure of the protein easily. In human cDNA research, to date, more than three million ESTs (Expression Sequence Tags) are publicly available, and the ESTs presumably cover not less than 80% of all human genes.

The information of ESTs is utilized for analyzing the structure of human genome, or for predicting the exon-regions of genomic sequences or their expression profile. However, many human ESTs have been derived from proximal regions to the 3'-end of cDNA, and information around the 5'-end of mRNA is extremely little. Among human cDNAs, the number of the corresponding mRNAs whose encoding full-length protein sequences are deduced is approximately 13,000.

It is possible to identify the transcription start site of mRNA on the genomic sequence based on the 5'-end sequence of a full-length cDNA, and to analyze factors involved in the stability of mRNA that is contained in the cDNA, or in its regulation of expression at the translation stage. Also, since a full-length cDNA contains atg codon, the translation start site, in the 5'-region, it can be translated into a protein in a correct frame. Therefore, it is possible to produce a large amount of the protein encoded by the cDNA or to analyze biological activity of the expressed protein by utilizing an appropriate expression system. Thus, analysis of a full-length cDNA provides valuable information which complements the information from genome sequencing. Also, full-length cDNA clones that can be expressed are extremely valuable in empirical analysis of gene function and in industrial application.

Therefore, if a novel human full-length cDNA is isolated, it can be used for developing medicines for diseases in which the gene is involved. The protein encoded by the gene can be used as a drug by itself. Thus, it has great significance to obtain a full-length cDNA encoding a novel human protein.

In particular, human secretory proteins or membrane proteins would be useful by itself as a medicine like tissue plasminogen activator (TPA), or as a target of medicines like membrane receptors. In addition, genes for signal transduction-related proteins (protein kinases, etc.), glycoprotein-related proteins, transcription-related proteins, etc. are genes whose relationships to human diseases have been elucidated. Moreover, genes for disease-related proteins form a gene group rich in genes whose relationships to human diseases have been elucidated.

Therefore, it has great significance to isolate novel full-length cDNA clones of human, only few of which has been isolated. Especially, isolation of a novel cDNA clone encoding a secretory protein or membrane protein is desired since the protein itself would be useful as a medicine, and also the clones potentially include a gene involved in diseases. In addition, genes encoding proteins that are involved in signal transduction, glycoprotein, transcription, or diseases are expected to be useful as target molecules for therapy, or as medicines themselves. These genes form a gene group predicted to be strongly involved in diseases. Thus, identification of the full-length cDNA clones encoding those proteins has great significance.

SUMMARY OF THE INVENTION

An objective of the present invention is to provide polynucleotides encoding novel polypeptides, polypeptides encoded by the polynucleotides, and novel usages of these.

The inventors have developed a method for efficiently cloning, from a cDNA library having very high fullness-ratio, a human full-length cDNA that is predicted to be a full-length cDNA clone, where the cDNA library is synthesized by an improved method (WO 01/04286) of the oligo-capping method (K. Maruyama and S. Sugano, Gene, 138: 171–174 (1994); Y. Suzuki et al., Gene, 200: 149–156 (1997)). Then, the nucleotide sequences of cDNA clones whose fullness ratio is high, obtained by this method, were determined mainly from their 5'-ends, and, if required, from 3'-ends.

Further, representative clones, which were estimated to be novel and full-length, among the clones obtained, were analyzed for their full-length nucleotide sequences. The determined full-length nucleotide sequences were analyzed by BLAST homology search of the databases shown below. Because the homology search of the present invention is carried out based on the information of full-length cDNAs including the entire coding regions, homology to every part of a polypeptide can be analyzed. Thus, in the present invention, the reliability of homology search has been greatly improved.

[1] SwissProt,
[2] GenBank,
[3] UniGene (Human), and
[4] nr (a protein database, which has been constructed by combining data of coding sequences (CDS) in nucleotide sequences deposited in GenBank, and data of SwissProt, PDB, PIR, and PRF; overlapping sequences have been removed.)

Further, the gene expression profiles of cDNA clones whose full-length nucleotide sequence had been determined were studied by analyzing the large-scale cDNA database constructed based on the 5'-end nucleotide sequences of cDNAs obtained. In addition to the analysis for the expression profile by computer, the profiles of gene expression in living cells were also determined by PCR. The present inventors revealed the usefulness of the genes of the present invention based on these analysis results.

In the present invention, gene functions were revealed by the analysis of expression profiles in silico based on the information of full-length nucleotide sequences. The expression profiles used in the expression frequency analysis were studied based on the database containing sufficient amount of fragment sequence data. The expression frequency analysis was carried out by referring, for these expression profiles, to the full-length nucleotide sequences of many cDNA clones obtained in the present invention. Thus, a highly reliable analysis can be achieved by referring to the full-length nucleotide sequences of a wide variety of genes for the sufficiently large population for analysis (expression profiles). Namely, the results of expression frequency analysis using the full-length sequences of the present invention more precisely reflect the gene expression frequency in tissues and cells from which a certain cDNA library was derived. In other words, the information of full-length cDNA nucleotide sequence of the present invention made it possible to achieve the highly reliable expression frequency analysis.

The full-length cDNA clones of this invention were obtained by the method comprising the steps of [1] preparing libraries containing cDNAs with the high fullness ratio by oligo-capping, and [2] assembling 5'-end sequences and selecting one with the highest probability of completeness in length in the cluster formed (there are many clones longer in the 5'-end direction). However, the uses of primers designed based on the 5'- and 3'-end sequences of polynucleotides provided by the present invention enable readily obtaining full-length cDNAs without such a special technique. The primer, which is designed to be used for obtaining cDNAs capable of being expressed, is not limited to the 5'- and 3'-end sequences of polynucleotide.

Specifically, the present invention relates to a polynucleotide selected from the group consisting of the following (a) to (g):

(a) a polynucleotide comprising a protein-coding region of the nucleotide sequence of any one of SEQ ID NOs shown in Table 1;
(b) a polynucleotide encoding a polypeptide comprising the amino acid sequence of any one of SEQ ID NOs shown in Table 1;
(c) a polynucleotide comprising a nucleotide sequence encoding a polypeptide comprising the amino acid sequence of any one of SEQ ID NOs shown in Table 1, wherein, in said amino acid sequence, one or more amino acids have been substituted, deleted, inserted, and/or added, and wherein said nucleotide sequence encodes a polypeptide functionally equivalent to a polypeptide comprising the selected amino acid sequence;
(d) a polynucleotide hybridizing under stringent conditions to a polynucleotide comprising the nucleotide sequence of any one of SEQ ID NOs shown in Table 1, wherein said nucleotide sequence encodes a polypeptide functionally equivalent to a polypeptide encoded by the selected nucleotide sequence;
(e) a polynucleotide comprising a nucleotide sequence encoding a partial amino acid sequence of a polypeptide encoded by the polynucleotide according to any one of (a) to (d);
(f) a polynucleotide comprising a nucleotide sequence having at least 70% identity to the nucleotide sequence of (a); and
(g) a polynucleotide comprising a nucleotide sequence having at least 90% identity to the nucleotide sequence of (a).

The present invention also relates to a polypeptide encoded by the above-mentioned polynucleotide or a partial peptide thereof, an antibody binding to the polypeptide or the peptide, and a method for immunologically assaying the polypeptide or the peptide, which comprises the steps of contacting the polypeptide or the peptide with the antibody, and observing the binding between the two.

Furthermore, the present invention features a vector comprising the above-mentioned polynucleotide, a transformant carrying the polynucleotide or the vector, a transformant carrying the polynucleotide or the vector in an expressible manner, and a method for producing the polypeptide or the peptide, which comprises the steps of culturing the transformant and recovering an expression product.

Another feature of the present invention is an oligonucleotide comprising at least 15 nucleotides, said oligonucleotide comprising a nucleotide sequence complementary to the nucleotide sequence of any one of SEQ ID NOs: 1 to 1970 or to a complementary strand thereof. This oligonucleotide can be used as a primer for synthesizing the above-mentioned polynucleotide or used as a probe for detecting the polynucleotide. The present invention includes an antisense polynucleotide against the polynucleotide or a part thereof, and a method for detecting the polynucleotide, which comprises the following steps of:

a) incubating a target polynucleotide with the oligonucleotide under hybridizable conditions, and
b) detecting hybridization of the target polynucleotide with the oligonucleotide.

Still another feature of the present invention is a database of polynucleotides and/or polypeptides, said database comprising information on at least one of the nucleotide sequences of SEQ ID NOs: 1 to 1970 and/or on at least one of the amino acid sequences of SEQ ID NOs: 1971 to 3940.

Herein, "polynucleotide" is defined as a molecule, such as DNA and RNA, in which multiple nucleotides are polymerized. There are no limitations on the number of the polymerized nucleotides. In case that the polymer contains relatively low number of nucleotides, it is also described as an "oligonucleotide", which is included in the "polynucleotide" of the present invention. The polynucleotide or the oligonucleotide of the present invention can be a natural or chemically synthesized product. Alternatively, it can be synthesized using a template, polynucleotide by an enzymatic reaction such as PCR. Furthermore, the polynucleotide of the present invention may be modified chemically. Moreover, not only a single-strand polynucleotide but also a double-strand polynucleotide is included in the present invention. In this specification, especially in claims, when the polynucleotide is described merely as "polynucleotide", it means not only a single-strand polynucleotide but also a double-strand polynucleotide. When it means double-strand polynucleotide, the nucleotide sequence of only one chain is indicated. However, based on the nucleotide sequence of a sense chain, the nucleotide sequence of the complementary strand thereof is essentially determined.

As used herein, an "isolated polynucleotide" is a polynucleotide the structure of which is not identical to that of any naturally occurring polynucleotide or to that of any fragment of a naturally occurring genomic polynucleotide spanning more than three separate genes. The term therefore includes, for example, (a) a DNA which has the sequence of part of a naturally occurring genomic DNA molecule in the genome of the organism in which it naturally occurs; (b) a polynucleotide incorporated into a vector or into the genomic DNA of a prokaryote or eukaryote in a manner such that the resulting molecule is not identical to any naturally occurring vector or genomic DNA; (c) a separate molecule such as a cDNA, a genomic fragment, a fragment produced by polymerase chain reaction (PCR), or a restriction fragment; and (d) a recombinant nucleotide sequence that is part of a hybrid gene, i.e., a gene encoding a fusion polypeptide. Specifically excluded from this definition are polynucleotides of DNA molecules present in mixtures of different (i) DNA molecules, (ii) transfected cells, or (iii) cell clones; e.g., as these occur in a DNA library such as a cDNA or genomic DNA library.

The term "substantially pure" as used herein in reference to a given protein or polypeptide means that the protein or polypeptide is substantially free from other biological macromolecules. For example,, the substantially pure protein or polypeptide is at least 75%, 80%, 85%, 95%, or 99% pure by dry weight. Purity can be measured by any appropriate standard method known in the art, for example, by column chromatography, polyacrylamide gel electrophoresis, or HPLC analysis.

All the cDNAs provided by the present invention are full-length cDNAs. The "full-length cDNA" herein means that the cDNA contains the ATG codon, which is the start point of translation therein. The untranslated regions upstream and downstream of the protein-coding region, both of which are naturally contained in natural mRNAs, are not indispensable. It is preferable that the full-length cDNAs of the present invention contain the stop codon.

DETAILED DESCRIPTION OF THE INVENTION

Figure 1:
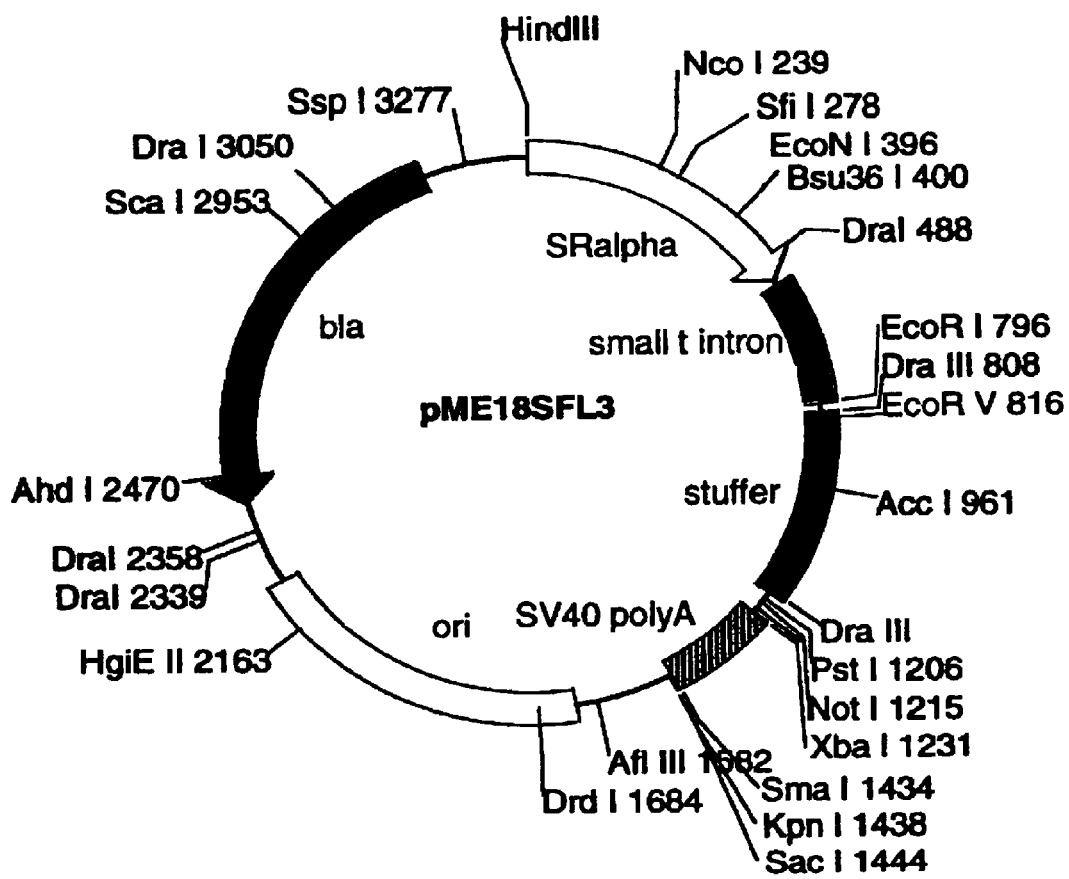
FIG. 1 shows the restriction map of the vector pME18SFL3.

All the clones (1970 clones) of the present invention are novel and encode the full-length polypeptides. Further, all the clones are cDNAs with the high fullness ratio, which were obtained by oligo-capping method, and also clones which are not identical to any of known human mRNAs (namely, novel clones) selected by searching, for the 5'-end sequences, mRNA sequences with the annotation of "complete cds" in the GenBank and UniGene databases by using-the BLAST homology search [S. F. Altschul, W. Gish, W. Miller, E. W. Myers & D. J. Lipman, J. Mol. Biol., 215: 403–410 (1990); W. Gish & D. J. States, Nature Genet., 3: 266–272 (1993)); they are also clones that were assumed to have higher fullness ratio among the members in the cluster formed by assembling. Most of the clones assessed to have high fullness ratio in the cluster had the nucleotide sequences longer in the 5'-end direction.

All the full-length cDNAs of the present invention can be synthesized by a method such as PCR (Current protocols in Molecular Biology edit. Ausubel et al. (1987) Publish. John Wiley & Sons Section 6.1–6.4) using primer sets designed based on the 5'-end and 3'-end sequences or using primer sets of primers designed based on the 5'-end sequences and a primer of oligo dT sequence corresponding to poly A sequence. Table 1 contains the clone names of full-length cDNA of 1970 clones of the present invention, SEQ ID NOs of the full-length nucleotide sequences, CDS portions deduced from the full-length nucleotide sequences, and SEQ ID NOs of the translated amino acids. The positions of CDS are shown according to the rule of "DDBJ/EMBL/GenBank Feature Table Definition". The start position number corresponds to the first letter of "ATG" that is the nucleotide triplet encoding methionine; the termination position number corresponds to the third letter of the stop codon. These are indicated being flanked with the mark "..". However, with respect to the clones having no stop codon, the termination position is indicated by the mark ">" according to the above rule.

TABLE 1

| Clone name | SEQ ID NO. of nucleotide sequence | Position of CDS | SEQ ID NO. of amino acid sequence |
|---|---|---|---|
| ADRGL20020290 | 1 | 62 . . . 1669 | 1971 |
| ADRGL20021910 | 2 | 150 . . . 707 | 1972 |
| ADRGL20022600 | 3 | 464 . . . 814 | 1973 |
| ADRGL20023920 | 4 | 375 . . . 1853 | 1974 |
| ADRGL20026790 | 5 | 113 . . . 2371 | 1975 |
| ADRGL20027530 | 6 | 2013 . . . 2372 | 1976 |
| ADRGL20036380 | 7 | 1129 . . . 1557 | 1977 |
| ADRGL20036840 | 8 | 260 . . . 889 | 1978 |
| ADRGL20040310 | 9 | 539 . . . 844 | 1979 |
| ADRGL20040770 | 10 | 817 . . . 1227 | 1980 |
| ADRGL20046760 | 11 | 1108 . . . 1467 | 1981 |
| ADRGL20047080 | 12 | 823 . . . 1134 | 1982 |
| ADRGL20047770 | 13 | 1532 . . . 1897 | 1983 |
| ADRGL20057560 | 14 | 376 . . . 846 | 1984 |
| ADRGL20059610 | 15 | 969 . . . 1961 | 1985 |
| ADRGL20062330 | 16 | 799 . . . > 2117 | 1986 |
| ADRGL20063770 | 17 | 344 . . . 664 | 1987 |
| ADRGL20066770 | 18 | 22 . . . 1416 | 1988 |
| ADRGL20067320 | 19 | 276 . . . 1016 | 1989 |
| ADRGL20079060 | 20 | 63 . . . 1748 | 1990 |
| ADRGL20095330 | 21 | 929 . . . 1516 | 1991 |
| ASTRO20001910 | 22 | 1753 . . . > 2216 | 1992 |
| ASTRO20003720 | 23 | 2089 . . . 2586 | 1993 |
| ASTRO20004820 | 24 | 444 . . . 1040 | 1994 |
| ASTRO20006530 | 25 | 2 . . . 1123 | 1995 |
| ASTRO20009140 | 26 | 344 . . . 1714 | 1996 |
| ASTRO20010010 | 27 | 1236 . . . 1727 | 1997 |
| ASTRO20010290 | 28 | 2 . . . 745 | 1998 |
| ASTRO20012270 | 29 | 286 . . . 627 | 1999 |
| ASTRO20020240 | 30 | 12 . . . 335 | 2000 |
| ASTRO20020350 | 31 | 1384 . . . 1854 | 2001 |
| ASTRO20022020 | 32 | 467 . . . 1093 | 2002 |
| ASTRO20026320 | 33 | 473 . . . 2161 | 2003 |
| ASTRO20027330 | 34 | 481 . . . 1101 | 2004 |
| ASTRO20038400 | 35 | 52 . . . 2025 | 2005 |
| ASTRO20045840 | 36 | 263 . . . 1051 | 2006 |
| ASTRO20046280 | 37 | 140 . . . 1402 | 2007 |
| ASTRO20047510 | 38 | 1240 . . . 1611 | 2008 |
| ASTRO20050810 | 39 | 171 . . . 1694 | 2009 |
| ASTRO20052420 | 40 | 1166 . . . 2362 | 2010 |
| ASTRO20053430 | 41 | 218 . . . 1885 | 2011 |
| ASTRO20055530 | 42 | 209 . . . 559 | 2012 |
| ASTRO20055570 | 43 | 242 . . . 733 | 2013 |
| ASTRO20055930 | 44 | 343 . . . 1086 | 2014 |
| ASTRO20058960 | 45 | 55 . . . 1215 | 2015 |
| ASTRO20069200 | 46 | 71 . . . 1237 | 2016 |
| ASTRO20075150 | 47 | 1004 . . . 1795 | 2017 |
| ASTRO20076660 | 48 | 1594 . . . 1968 | 2018 |
| ASTRO20085080 | 49 | 470 . . . 2011 | 2019 |
| ASTRO20088950 | 50 | 346 . . . 1530 | 2020 |
| ASTRO20089600 | 51 | 142 . . . 1125 | 2021 |

TABLE 1-continued

| Clone name | SEQ ID NO. of nucleotide sequence | Position of CDS | SEQ ID NO. of amino acid sequence |
|---|---|---|---|
| ASTRO20090680 | 52 | 1221 . . . > 2631 | 2022 |
| ASTRO20091180 | 53 | 12 . . . 1214 | 2023 |
| ASTRO20091770 | 54 | 10 . . . 318 | 2024 |
| ASTRO20141740 | 55 | 30 . . . 347 | 2025 |
| BGGI120000670 | 56 | 240 . . . 614 | 2026 |
| BGGI120010750 | 57 | 72 . . . > 2507 | 2027 |
| BNGH410000570 | 58 | 957 . . . 2027 | 2028 |
| BNGH420008150 | 59 | 596 . . . 1606 | 2029 |
| BNGH420014060 | 60 | 1072 . . . 1413 | 2030 |
| BNGH420015760 | 61 | 92 . . . 1336 | 2031 |
| BNGH420021680 | 62 | 147 . . . 2093 | 2032 |
| BNGH420023870 | 63 | 301 . . . 1851 | 2033 |
| BNGH420024870 | 64 | 155 . . . 1960 | 2034 |
| BNGH420035290 | 65 | 114 . . . 2126 | 2035 |
| BNGH420036410 | 66 | 1778 . . . 2143 | 2036 |
| BNGH420040760 | 67 | 698 . . . 1162 | 2037 |
| BNGH420042910 | 68 | 191 . . . 721 | 2038 |
| BNGH420045380 | 69 | 721 . . . 1254 | 2039 |
| BNGH420046790 | 70 | 1079 . . . 1429 | 2040 |
| BNGH420052350 | 71 | 787 . . . 1146 | 2041 |
| BNGH420059680 | 72 | 213 . . . 2393 | 2042 |
| BNGH420061350 | 73 | 600 . . . 3131 | 2043 |
| BNGH420062340 | 74 | 294 . . . 641 | 2044 |
| BNGH420070370 | 75 | 567 . . . 2429 | 2045 |
| BNGH420074600 | 76 | 125 . . . 1696 | 2046 |
| BNGH420075940 | 77 | 31 . . . 510 | 2047 |
| BNGH420077980 | 78 | 288 . . . 2147 | 2048 |
| BNGH420085100 | 79 | 243 . . . 569 | 2049 |
| BNGH420086030 | 80 | 107 . . . > 2556 | 2050 |
| BNGH420087430 | 81 | 195 . . . 1835 | 2051 |
| BRACE10000510 | 82 | 642 . . . 1703 | 2052 |
| BRACE20003310 | 83 | 1379 . . . 2893 | 2053 |
| BRACE20007330 | 84 | 339 . . . 2015 | 2054 |
| BRACE20009050 | 85 | 1023 . . . 1493 | 2055 |
| BRACE20014450 | 86 | 161 . . . 1096 | 2056 |
| BRACE20017790 | 87 | 304 . . . 639 | 2057 |
| BRACE20018810 | 88 | 397 . . . 1146 | 2058 |
| BRACE20025820 | 89 | 453 . . . 767 | 2059 |
| BRACE20038920 | 90 | 1122 . . . 1463 | 2060 |
| BRACE20050870 | 91 | 110 . . . 1987 | 2061 |
| BRACE20051600 | 92 | 443 . . . 895 | 2062 |
| BRACE20051930 | 93 | 173 . . . 901 | 2063 |
| BRACE20052430 | 94 | 825 . . . 1637 | 2064 |
| BRACE20052530 | 95 | 98 . . . 490 | 2065 |
| BRACE20054080 | 96 | 762 . . . 1382 | 2066 |
| BRACE20054480 | 97 | 111 . . . 902 | 2067 |
| BRACE20054600 | 98 | 392 . . . 1276 | 2068 |
| BRACE20055560 | 99 | 136 . . . 735 | 2069 |
| BRACE20057870 | 100 | 1169 . . . 1825 | 2070 |
| BRACE20059110 | 101 | 1452 . . . 1910 | 2071 |
| BRACE20059810 | 102 | 689 . . . 2218 | 2072 |
| BRACE20061620 | 103 | 162 . . . 1163 | 2073 |
| BRACE20062580 | 104 | 1164 . . . 1859 | 2074 |
| BRACE20063540 | 105 | 378 . . . 1670 | 2075 |
| BRACE20065470 | 106 | 427 . . . 1101 | 2076 |
| BRACE20066360 | 107 | 233 . . . 736 | 2077 |
| BRACE20068710 | 108 | 1099 . . . 1440 | 2078 |
| BRACE20069000 | 109 | 1355 . . . 2305 | 2079 |
| BRACE20069110 | 110 | 576 . . . 917 | 2080 |
| BRACE20069440 | 111 | 278 . . . 1504 | 2081 |
| BRACE20079200 | 112 | 928 . . . 1413 | 2082 |
| BRACE20079370 | 113 | 158 . . . 1522 | 2083 |
| BRACE20097540 | 114 | 1474 . . . 2103 | 2084 |
| BRACE20098860 | 115 | 693 . . . 1193 | 2085 |
| BRACE20099070 | 116 | 53 . . . 1441 | 2086 |
| BRACE20194670 | 117 | 11 . . . 616 | 2087 |
| BRACE20196180 | 118 | 35 . . . 916 | 2088 |
| BRACE20196960 | 119 | 1454 . . . 1912 | 2089 |
| BRACE20200770 | 120 | 306 . . . 683 | 2090 |
| BRACE20200970 | 121 | 426 . . . 764 | 2091 |
| BRACE20204670 | 122 | 760 . . . 2124 | 2092 |
| BRACE20205840 | 123 | 40 . . . 387 | 2093 |
| BRACE20207420 | 124 | 119 . . . 469 | 2094 |
| BRACE20212450 | 125 | 168 . . . 590 | 2095 |
| BRACE20215410 | 126 | 111 . . . 1361 | 2096 |
| BRACE20216700 | 127 | 1403 . . . 1738 | 2097 |
| BRACE20216950 | 128 | 911 . . . 1315 | 2098 |
| BRACE20219360 | 129 | 198 . . . 596 | 2099 |
| BRAMY10000980 | 130 | 254 . . . 616 | 2100 |
| BRAMY10001730 | 131 | 796 . . . 1158 | 2101 |
| BRAMY20000210 | 132 | 134 . . . 445 | 2102 |
| BRAMY20000250 | 133 | 190 . . . 1932 | 2103 |
| BRAMY20001510 | 134 | 129 . . . 917 | 2104 |
| BRAMY20003540 | 135 | 144 . . . 2477 | 2105 |
| BRAMY20003880 | 136 | 191 . . . 808 | 2106 |
| BRAMY20005080 | 137 | 1638 . . . 1958 | 2107 |
| BRAMY20013670 | 138 | 551 . . . 2881 | 2108 |
| BRAMY20016780 | 139 | 273 . . . 1985 | 2109 |
| BRAMY20020440 | 140 | 359 . . . 685 | 2110 |
| BRAMY20021580 | 141 | 67 . . . 555 | 2111 |
| BRAMY20023390 | 142 | 1568 . . . 1939 | 2112 |
| BRAMY20023640 | 143 | 1684 . . . 2280 | 2113 |
| BRAMY20024790 | 144 | 276 . . . 626 | 2114 |
| BRAMY20027390 | 145 | 420 . . . 782 | 2115 |
| BRAMY20027990 | 146 | 529 . . . 1572 | 2116 |
| BRAMY20028530 | 147 | 973 . . . 1278 | 2117 |
| BRAMY20028620 | 148 | 1048 . . . 1434 | 2118 |
| BRAMY20035380 | 149 | 925 . . . 1707 | 2119 |
| BRAMY20035830 | 150 | 219 . . . 977 | 2120 |
| BRAMY20036530 | 151 | 1411 . . . 1761 | 2121 |
| BRAMY20036810 | 152 | 321 . . . 644 | 2122 |
| BRAMY20038980 | 153 | 715 . . . > 2057 | 2123 |
| BRAMY20039290 | 154 | 81 . . . 1043 | 2124 |
| BRAMY20040580 | 155 | 374 . . . 769 | 2125 |
| BRAMY20043520 | 156 | 942 . . . 1778. | 2126 |
| BRAMY20043630 | 157 | 25 . . . 1119 | 2127 |
| BRAMY20044920 | 158 | 40 . . . 1947 | 2128 |
| BRAMY20045210 | 159 | 367 . . . 750 | 2129 |
| BRAMY20045420 | 160 | 4 . . . 888 | 2130 |
| BRAMY20047560 | 161 | 220 . . . 726 | 2131 |
| BRAMY20050640 | 162 | 1802 . . . 2635 | 2132 |
| BRAMY20050940 | 163 | 23 . . . 385 | 2133 |
| BRAMY20051820 | 164 | 1411 . . . 2157 | 2134 |
| BRAMY20052440 | 165 | 29 . . . 448 | 2135 |
| BRAMY20053910 | 166 | 11 . . . 358 | 2136 |
| BRAMY20055760 | 167 | 664 . . . 2253 | 2137 |
| BRAMY20056620 | 168 | 46 . . . 726 | 2138 |
| BRAMY20056840 | 169 | 40 . . . 1392 | 2139 |
| BRAMY20063750 | 170 | 535 . . . 2166 | 2140 |
| BRAMY20072440 | 171 | 823 . . . 1620 | 2141 |
| BRAMY20072870 | 172 | 437 . . . 910 | 2142 |
| BRAMY20073080 | 173 | 3 . . . 353 | 2143 |
| BRAMY20074110 | 174 | 314 . . . 838 | 2144 |
| BRAMY20074860 | 175 | 1135 . . . 1524 | 2145 |
| BRAMY20076100 | 176 | 459 . . . 1019 | 2146 |
| BRAMY20076130 | 177 | 59 . . . 376 | 2147 |
| BRAMY20076530 | 178 | 1010 . . . 1465 | 2148 |
| BRAMY20083330 | 179 | 10 . . . 492 | 2149 |
| BRAMY20083820 | 180 | 625 . . . 1113 | 2150 |
| BRAMY20089770 | 181 | 173 . . . 955 | 2151 |
| BRAMY20091230 | 182 | 818 . . . 1579 | 2152 |
| BRAMY20093490 | 183 | 637 . . . 1080 | 2153 |
| BRAMY20094890 | 184 | 30 . . . 2138 | 2154 |
| BRAMY20095080 | 185 | 239 . . . 613 | 2155 |
| BRAMY20095570 | 186 | 109 . . . 807 | 2156 |
| BRAMY20096930 | 187 | 1381 . . . 1800 | 2157 |
| BRAMY20100680 | 188 | 268 . . . 870 | 2158 |
| BRAMY20102900 | 189 | 200 . . . 760 | 2159 |
| BRAMY20107980 | 190 | 343 . . . 669 | 2160 |
| BRAMY20111780 | 191 | 584 . . . 2209 | 2161 |
| BRAMY20117670 | 192 | 63 . . . 782 | 2162 |
| BRAMY20118410 | 193 | 24 . . . 782 | 2163 |
| BRAMY20118490 | 194 | 39 . . . 791 | 2164 |
| BRAMY20120170 | 195 | 1130 . . . 1459 | 2165 |
| BRAMY20123400 | 196 | 1420 . . . 1755 | 2166 |
| BRAMY20124970 | 197 | 825 . . . 1226 | 2167 |
| BRAMY20125170 | 198 | 157 . . . 579 | 2168 |
| BRAMY20125360 | 199 | 134 . . . 1060 | 2169 |
| BRAMY20125550 | 200 | 29 . . . 1747 | 2170 |
| BRAMY20126910 | 201 | 114 . . . 518 | 2171 |

TABLE 1-continued

| Clone name | SEQ ID NO. of nucleotide sequence | Position of CDS | SEQ ID NO. of amino acid sequence |
|---|---|---|---|
| BRAMY20127310 | 202 | 1986 ... 2336 | 2172 |
| BRAMY20127760 | 203 | 317 ... 691 | 2173 |
| BRAMY20134050 | 204 | 199 ... 522 | 2174 |
| BRAMY20135720 | 205 | 57 ... 401 | 2175 |
| BRAMY20137360 | 206 | 976 ... 2193 | 2176 |
| BRAMY20139440 | 207 | 2 ... 1597 | 2177 |
| BRAMY20139750 | 208 | 88 ... 435 | 2178 |
| BRAMY20143870 | 209 | 1419 ... 2102 | 2179 |
| BRAMY20152510 | 210 | 296 ... 1993 | 2180 |
| BRAMY20155500 | 211 | 722 ... 1069 | 2181 |
| BRAMY20158550 | 212 | 142 ... 951 | 2182 |
| BRAMY20159250 | 213 | 286 ... 810 | 2183 |
| BRAMY20160020 | 214 | 143 ... 919 | 2184 |
| BRAMY20173480 | 215 | 1544 ... 1906 | 2185 |
| BRAMY20190550 | 216 | 114 ... 1640 | 2186 |
| BRAMY20194680 | 217 | 1179 ... 1517 | 2187 |
| BRAMY20204270 | 218 | 218 ... 844 | 2188 |
| BRAMY20206340 | 219 | 237 ... 1805 | 2189 |
| BRAMY20219620 | 220 | 1014 ... 1670 | 2190 |
| BRAMY20221600 | 221 | 168 ... 992 | 2191 |
| BRAMY20223010 | 222 | 466 ... 1257 | 2192 |
| BRAMY20225250 | 223 | 368 ... 673 | 2193 |
| BRAMY20225320 | 224 | 241 ... 840 | 2194 |
| BRAMY20227230 | 225 | 1327 ... 2067 | 2195 |
| BRAMY20227860 | 226 | 10 ... 657 | 2196 |
| BRAMY20227960 | 227 | 1148 ... 1558 | 2197 |
| BRAMY20231150 | 228 | 199 ... 1146 | 2198 |
| BRAMY20234820 | 229 | 199 ... 2079 | 2199 |
| BRAMY20237190 | 230 | 397 ... 870 | 2200 |
| BRAMY20238630 | 231 | 303 ... 1331 | 2201 |
| BRAMY20243120 | 232 | 1756 ... 2451 | 2202 |
| BRAMY20244490 | 233 | 257 ... 982 | 2203 |
| BRAMY20245140 | 234 | 3 ... 1295 | 2204 |
| BRAMY20245350 | 235 | 94 ... 750 | 2205 |
| BRAMY20245760 | 236 | 35 ... 1375 | 2206 |
| BRAMY20251210 | 237 | 68 ... 955 | 2207 |
| BRAMY20251750 | 238 | 97 ... 846 | 2208 |
| BRAMY20263000 | 239 | 216 ... 1553 | 2209 |
| BRAMY20267780 | 240 | 1194 ... 1706 | 2210 |
| BRAMY20269040 | 241 | 989 ... 2071 | 2211 |
| BRAMY20271140 | 242 | 1582 ... 2238 | 2212 |
| BRAMY20274510 | 243 | 1785 ... 2138 | 2213 |
| BRAMY20285650 | 244 | 23 ... 382 | 2214 |
| BRAMY20287400 | 245 | 1 ... 456 | 2215 |
| BRAWH20014590 | 246 | 125 ... 856 | 2216 |
| BRAWH20020470 | 247 | 131 ... > 2130 | 2217 |
| BRAWH20020600 | 248 | 402 ... 722 | 2218 |
| BRAWH20021910 | 249 | 394 ... 1803 | 2219 |
| BRAWH20025490 | 250 | 1699 ... 2106 | 2220 |
| BRAWH20026010 | 251 | 307 ... 2034 | 2221 |
| BRAWH20027250 | 252 | 942 ... 1499 | 2222 |
| BRAWH20030000 | 253 | 381 ... 1286 | 2223 |
| BRAWH20039640 | 254 | 109 ... > 2281 | 2224 |
| BRAWH20040680 | 255 | 201 ... 2291 | 2225 |
| BRAWH20047790 | 256 | 290 ... 631 | 2226 |
| BRAWH20050740 | 257 | 512 ... > 1907 | 2227 |
| BRAWH20055240 | 258 | 1339 ... 1653 | 2228 |
| BRAWH20055330 | 259 | 1507 ... 1911 | 2229 |
| BRAWH20055780 | 260 | 354 ... 953 | 2230 |
| BRAWH20058120 | 261 | 896 ... 1501 | 2231 |
| BRAWH20063010 | 262 | 1839 ... 2579 | 2232 |
| BRAWH20078080 | 263 | 161 ... 745 | 2233 |
| BRAWH20078620 | 264 | 99 ... 470 | 2234 |
| BRAWH20080580 | 265 | 35 ... 1000 | 2235 |
| BRAWH20082550 | 266 | 2191 ... 2670 | 2236 |
| BRAWH20082920 | 267 | 1579 ... 2124 | 2237 |
| BRAWH20093040 | 268 | 1202 ... 1855 | 2238 |
| BRAWH20093070 | 269 | 469 ... 1569 | 2239 |
| BRAWH20094900 | 270 | 712 ... 2166 | 2240 |
| BRAWH20095900 | 271 | 247 ... 2178 | 2241 |
| BRAWH20173790 | 272 | 634 ... 1428 | 2242 |
| BRAWH20174330 | 273 | 2532 ... 3272 | 2243 |
| BRAWH20175230 | 274 | 1119 ... 1451 | 2244 |
| BRAWH20175340 | 275 | 88 ... 504 | 2245 |
| BRAWH20176850 | 276 | 32 ... 2203 | 2246 |
| BRAWH20182670 | 277 | 2751 ... 3059 | 2247 |
| BRAWH20183170 | 278 | 106 ... 909 | 2248 |
| BRAWH20185260 | 279 | 204 ... 1946 | 2249 |
| BRAWH20185270 | 280 | 15 ... 869 | 2250 |
| BRAWH20186010 | 281 | 886 ... 1389 | 2251 |
| BRAWH20188750 | 282 | 21 ... 824 | 2252 |
| BRAWH20190530 | 283 | 410 ... 1024 | 2253 |
| BRAWH20190550 | 284 | 55 ... 1533 | 2254 |
| BRAWH20191980 | 285 | 1426 ... 2172 | 2255 |
| BRCAN10000760 | 286 | 548 ... 1885 | 2256 |
| BRCAN10001050 | 287 | 388 ... 828 | 2257 |
| BRCAN10001680 | 288 | 519 ... 998 | 2258 |
| BRCAN20001480 | 289 | 114 ... 449 | 2259 |
| BRCAN20004180 | 290 | 8 ... 331 | 2260 |
| BRCAN20005230 | 291 | 63 ... 590 | 2261 |
| BRCAN20005410 | 292 | 52 ... 1335 | 2262 |
| BRCOC10000400 | 293 | 11 ... 3664 | 2263 |
| BRCOC20000470 | 294 | 283 ... 1851 | 2264 |
| BRCOC20003600 | 295 | 163 ... 1455 | 2265 |
| BRHIP10000720 | 296 | 4 ... 312 | 2266 |
| BRHIP10001040 | 297 | 76 ... 1317 | 2267 |
| BRHIP20000210 | 298 | 7 ... 378 | 2268 |
| BRHIP20003590 | 299 | 618 ... 1238 | 2269 |
| BRHIP20005060 | 300 | 756 ... 1178 | 2270 |
| BRSSN20001970 | 301 | 89 ... 526 | 2271 |
| BRSSN20005610 | 302 | 174 ... > 2375 | 2272 |
| BRSSN20005660 | 303 | 2089 ... > 2535 | 2273 |
| BRSSN20066440 | 304 | 248 ... 1474 | 2274 |
| BRSSN20074640 | 305 | 257 ... 985 | 2275 |
| BRSSN20091190 | 306 | 1214 ... 2002 | 2276 |
| BRSSN20092440 | 307 | 4 ... 396 | 2277 |
| BRSSN20093890 | 308 | 94 ... 717 | 2278 |
| CD34C20001750 | 309 | 10 ... 840 | 2279 |
| CTONG10000090 | 310 | 2551 ... 2991 | 2280 |
| CTONG20000340 | 311 | 856 ... 1929 | 2281 |
| CTONG20002790 | 312 | 373 ... 708 | 2282 |
| CTONG20004110 | 313 | 74 ... 3079 | 2283 |
| CTONG20004520 | 314 | 146 ... 772 | 2284 |
| CTONG20007660 | 315 | 192 ... 1448 | 2285 |
| CTONG20008190 | 316 | 1313 ... 1789 | 2286 |
| CTONG20008460 | 317 | 1034 ... 1849 | 2287 |
| CTONG20015240 | 318 | 134 ... 874 | 2288 |
| CTONG20017490 | 319 | 346 ... 2235 | 2289 |
| CTONG20020660 | 320 | 219 ... 635 | 2290 |
| CTONG20020950 | 321 | 24 ... 3257 | 2291 |
| CTONG20027660 | 322 | 103 ... 942 | 2292 |
| CTONG20029030 | 323 | 102 ... 2492 | 2293 |
| CTONG20030280 | 324 | 219 ... 2891 | 2294 |
| CTONG20031150 | 325 | 2175 ... 2546 | 2295 |
| CTONG20031890 | 326 | 8 ... 1705 | 2296 |
| CTONG20032930 | 327 | 352 ... 3102 | 2297 |
| CTONG20033500 | 328 | 1683 ... 2018 | 2298 |
| CTONG20033610 | 329 | 404 ... > 3203 | 2299 |
| CTONG20033750 | 330 | 95 ... 1999 | 2300 |
| CTONG20035240 | 331 | 234 ... 2687 | 2301 |
| CTONG20036800 | 332 | 432 ... 770 | 2302 |
| CTONG20036990 | 333 | 1568 ... 2347 | 2303 |
| CTONG20039370 | 334 | 114 ... 470 | 2304 |
| CTONG20041150 | 335 | 406 ... 1164 | 2305 |
| CTONG20041260 | 336 | 477 ... 2276 | 2306 |
| CTONG20042640 | 337 | 6 ... 2381 | 2307 |
| CTONG20044230 | 338 | 1199 ... 3205 | 2308 |
| CTONG20044870 | 339 | 17 ... 2554 | 2309 |
| CTONG20045500 | 340 | 226 ... 1950 | 2310 |
| CTONG20046690 | 341 | 385 ... 840 | 2311 |
| CTONG20049480 | 342 | 216 ... > 3268 | 2312 |
| CTONG20050490 | 343 | 428 ... 859 | 2313 |
| CTONG20051100 | 344 | 48 ... 419 | 2314 |
| CTONG20051450 | 345 | 1239 ... 1823 | 2315 |
| CTONG20052780 | 346 | 976 ... 1656 | 2316 |
| CTONG20053990 | 347 | 2233 ... > 2955 | 2317 |
| CTONG20055670 | 348 | 2306 ... 2620 | 2318 |
| CTONG20055850 | 349 | 506 ... 1246 | 2319 |
| CTONG20056150 | 350 | 95 ... 1150 | 2320 |
| CTONG20057750 | 351 | 2355 ... 2849 | 2321 |

TABLE 1-continued

| Clone name | SEQ ID NO. of nucleotide sequence | Position of CDS | SEQ ID NO. of amino acid sequence |
|---|---|---|---|
| CTONG20057950 | 352 | 3061 ... 3420 | 2322 |
| CTONG20059130 | 353 | 109 ... 2613 | 2323 |
| CTONG20060040 | 354 | 204 ... 2630 | 2324 |
| CTONG20061290 | 355 | 226 ... 819 | 2325 |
| CTONG20062730 | 356 | 307 ... 687 | 2326 |
| CTONG20063770 | 357 | 108 ... 3203 | 2327 |
| CTONG20063930 | 358 | 250 ... 2700 | 2328 |
| CTONG20065240 | 359 | 1983 ... 2333 | 2329 |
| CTONG20065680 | 360 | 2369 ... 2797 | 2330 |
| CTONG20066110 | 361 | 122 ... 1972 | 2331 |
| CTONG20068360 | 362 | 1136 ... 1876 | 2332 |
| CTONG20069320 | 363 | 843 ... 1238 | 2333 |
| CTONG20069420 | 364 | 130 ... 600 | 2334 |
| CTONG20070090 | 365 | 561 ... 2960 | 2335 |
| CTONG20070720 | 366 | 431 ... 2677 | 2336 |
| CTONG20070780 | 367 | 2 ... 2896 | 2337 |
| CTONG20070910 | 368 | 87 ... 1397 | 2338 |
| CTONG20071040 | 369 | 16 ... 1551 | 2339 |
| CTONG20071680 | 370 | 189 ... > 2419 | 2340 |
| CTONG20072930 | 371 | 193 ... 2643 | 2341 |
| CTONG20073990 | 372 | 749 ... 2428 | 2342 |
| CTONG20074000 | 373 | 81 ... 3185 | 2343 |
| CTONG20074170 | 374 | 153 ... 1211 | 2344 |
| CTONG20074740 | 375 | 2754 ... > 3085 | 2345 |
| CTONG20076230 | 376 | 2192 ... 2560 | 2346 |
| CTONG20076810 | 377 | 909 ... 2402 | 2347 |
| CTONG20077760 | 378 | 1517 ... 2170 | 2348 |
| CTONG20078340 | 379 | 100 ... 2229 | 2349 |
| CTONG20079590 | 380 | 149 ... 1066 | 2350 |
| CTONG20080140 | 381 | 159 ... 686 | 2351 |
| CTONG20081840 | 382 | 586 ... 897 | 2352 |
| CTONG20083430 | 383 | 159 ... 1325 | 2353 |
| CTONG20083980 | 384 | 106 ... 1440 | 2354 |
| CTONG20084020 | 385 | 301 ... 666 | 2355 |
| CTONG20084660 | 386 | 217 ... 753 | 2356 |
| CTONG20085210 | 387 | 769 ... 1878 | 2357 |
| CTONG20133720 | 388 | 15 ... 350 | 2358 |
| CTONG20165590 | 389 | 1721 ... 2044 | 2359 |
| CTONG20165750 | 390 | 216 ... 1955 | 2360 |
| CTONG20166580 | 391 | 320 ... 1612 | 2361 |
| CTONG20167750 | 392 | 159 ... 461 | 2362 |
| CTONG20168240 | 393 | 491 ... 856 | 2363 |
| CTONG20168460 | 394 | 569 ... 871 | 2364 |
| CTONG20169040 | 395 | 139 ... 894 | 2365 |
| CTONG20169530 | 396 | 1076 ... 1399 | 2366 |
| CTONG20170940 | 397 | 184 ... 1569 | 2367 |
| CTONG20174290 | 398 | 96 ... 1826 | 2368 |
| CTONG20174440 | 399 | 1246 ... 1623 | 2369 |
| CTONG20174580 | 400 | 1 ... 1023 | 2370 |
| CTONG20176040 | 401 | 147 ... 737 | 2371 |
| CTONG20179390 | 402 | 1423 ... 1881 | 2372 |
| CTONG20179890 | 403 | 335 ... 2344 | 2373 |
| CTONG20179980 | 404 | 1821 ... 2210 | 2374 |
| CTONG20180620 | 405 | 1556 ... 1915 | 2375 |
| CTONG20180690 | 406 | 366 ... 1442 | 2376 |
| CTONG20181350 | 407 | 1167 ... 1607 | 2377 |
| CTONG20183430 | 408 | 319 ... 2706 | 2378 |
| CTONG20183830 | 409 | 393 ... 2687 | 2379 |
| CTONG20184130 | 410 | 1970 ... 2536 | 2380 |
| CTONG20184830 | 411 | 323 ... 1204 | 2381 |
| CTONG20186140 | 412 | 21 ... 443 | 2382 |
| CTONG20186290 | 413 | 2170 ... 2811 | 2383 |
| CTONG20186370 | 414 | 156 ... 1244 | 2384 |
| CTONG20186520 | 415 | 211 ... 2136 | 2385 |
| CTONG20186550 | 416 | 260 ... 811 | 2386 |
| CTONG20188080 | 417 | 207 ... 2774 | 2387 |
| CTONG20189000 | 418 | 174 ... 1682 | 2388 |
| CTONG20190290 | 419 | 220 ... 2205 | 2389 |
| CTONG20190630 | 420 | 34 ... 2082 | 2390 |
| DFNES20016470 | 421 | 288 ... 851 | 2391 |
| DFNES20018000 | 422 | 40 ... 1596 | 2392 |
| DFNES20025500 | 423 | 766 ... 1134 | 2393 |
| DFNES20028170 | 424 | 289 ... 1734 | 2394 |
| DFNES20029660 | 425 | 356 ... 2443 | 2395 |
| DFNES20032550 | 426 | 35 ... 931 | 2396 |
| DFNES20043710 | 427 | 108 ... 929 | 2397 |
| DFNES20046840 | 428 | 786 ... 1310 | 2398 |
| DFNES20055400 | 429 | 343 ... 1584 | 2399 |
| DFNES20057660 | 430 | 25 ... 795 | 2400 |
| DFNES20063460 | 431 | 26 ... 406 | 2401 |
| DFNES20072990 | 432 | 62 ... 1156 | 2402 |
| DFNES20073320 | 433 | 377 ... 1735 | 2403 |
| DFNES20076340 | 434 | 167 ... 898 | 2404 |
| DFNES20080880 | 435 | 11 ... 1669 | 2405 |
| DFNES20088810 | 436 | 171 ... 548 | 2406 |
| DFNES20094820 | 437 | 107 ... 1807 | 2407 |
| FCBBF10000230 | 438 | 104 ... 3247 | 2408 |
| FCBBF10002200 | 439 | 480 ... 782 | 2409 |
| FCBBF10004760 | 440 | 578 ... 1978 | 2410 |
| FCBBF20018680 | 441 | 177 ... 1724 | 2411 |
| FCBBF20020440 | 442 | 382 ... 885 | 2412 |
| FCBBF20021110 | 443 | 158 ... 517 | 2413 |
| FCBBF20023490 | 444 | 64 ... 1779 | 2414 |
| FCBBF20028980 | 445 | 694 ... 1014 | 2415 |
| FCBBF20029280 | 446 | 1680 ... 2021 | 2416 |
| FCBBF20032930 | 447 | 90 ... 452 | 2417 |
| FCBBF20033360 | 448 | 315 ... 2369 | 2418 |
| FCBBF20035430 | 449 | 196 ... 726 | 2419 |
| FCBBF20035490 | 450 | 131 ... 1387 | 2420 |
| FCBBF20036360 | 451 | 16 ... 366 | 2421 |
| FCBBF20038230 | 452 | 1468 ... 1908 | 2422 |
| FCBBF20038950 | 453 | 648 ... 992 | 2423 |
| FCBBF20041380 | 454 | 612 ... 2174 | 2424 |
| FCBBF20043730 | 455 | 45 ... > 2063 | 2425 |
| FCBBF20054390 | 456 | 1367 ... 1756 | 2426 |
| FCBBF20056580 | 457 | 82 ... > 2394 | 2427 |
| FCBBF20059660 | 458 | 672 ... 1226 | 2428 |
| FCBBF20061310 | 459 | 1582 ... 1980 | 2429 |
| FCBBF20066340 | 460 | 116 ... 1024 | 2430 |
| FCBBF20070800 | 461 | 968 ... 1447 | 2431 |
| FCBBF20070950 | 462 | 50 ... > 2299 | 2432 |
| FCBBF30000010 | 463 | 74 ... 643 | 2433 |
| FCBBF30001020 | 464 | 16 ... 348 | 2434 |
| FCBBF30001100 | 465 | 341 ... > 3125 | 2435 |
| FCBBF30001150 | 466 | 1209 ... 1631 | 2436 |
| FCBBF30002270 | 467 | 319 ... 927 | 2437 |
| FCBBF30002280 | 468 | 113 ... 4036 | 2438 |
| FCBBF30002330 | 469 | 6 ... 611 | 2439 |
| FCBBF30003610 | 470 | 1015 ... 2019 | 2440 |
| FCBBF30004340 | 471 | 120 ... 1013 | 2441 |
| FCBBF30004730 | 472 | 368 ... 1027 | 2442 |
| FCBBF30005180 | 473 | 155 ... 2734 | 2443 |
| FCBBF30005360 | 474 | 29 ... 2710 | 2444 |
| FCBBF30005500 | 475 | 251 ... 2494 | 2445 |
| FCBBF30019140 | 476 | 40 ... 2979 | 2446 |
| FCBBF30019180 | 477 | 140 ... 1669 | 2447 |
| FCBBF30019240 | 478 | 1214 ... 2269 | 2448 |
| FCBBF30021900 | 479 | 63 ... 1973 | 2449 |
| FCBBF30022680 | 480 | 1308 ... 2480 | 2450 |
| FCBBF30026580 | 481 | 170 ... 2725 | 2451 |
| FCBBF30029250 | 482 | 52 ... 4086 | 2452 |
| FCBBF30035570 | 483 | 217 ... > 2468 | 2453 |
| FCBBF30042610 | 484 | 33 ... 1244 | 2454 |
| FCBBF30048420 | 485 | 144 ... 1094 | 2455 |
| FCBBF30053300 | 486 | 62 ... 2182 | 2456 |
| FCBBF30056980 | 487 | 1098 ... 1415 | 2457 |
| FCBBF30062490 | 488 | 128 ... 1063 | 2458 |
| FCBBF30063990 | 489 | 250 ... 828 | 2459 |
| FCBBF30068210 | 490 | 51 ... 2762 | 2460 |
| FCBBF30071500 | 491 | 227 ... > 2898 | 2461 |
| FCBBF30072440 | 492 | 2485 ... 2865 | 2462 |
| FCBBF30072480 | 493 | 2602 ... > 3057 | 2463 |
| FCBBF30074530 | 494 | 1031 ... 1432 | 2464 |
| FCBBF30074620 | 495 | 840 ... 1316 | 2465 |
| FCBBF30075970 | 496 | 146 ... 460 | 2466 |
| FCBBF30076310 | 497 | 42 ... 1007 | 2467 |
| FCBBF30078600 | 498 | 113 ... 1399 | 2468 |
| FCBBF30079770 | 499 | 693 ... 2777 | 2469 |
| FCBBF30080730 | 500 | 54 ... 467 | 2470 |
| FCBBF30081000 | 501 | 526 ... 924 | 2471 |

TABLE 1-continued

| Clone name | SEQ ID NO. of nucleotide sequence | Position of CDS | SEQ ID NO. of amino acid sequence |
|---|---|---|---|
| FCBBF30085560 | 502 | 60 ... 1919 | 2472 |
| FCBBF30088700 | 503 | 39 ... > 3015 | 2473 |
| FCBBF30089380 | 504 | 8 ... 2701 | 2474 |
| FCBBF30091010 | 505 | 172 ... > 3465 | 2475 |
| FCBBF30091520 | 506 | 56 ... 2284 | 2476 |
| FCBBF30093170 | 507 | 974 ... 1528 | 2477 |
| FCBBF30095410 | 508 | 64 ... 1002 | 2478 |
| FCBBF30099490 | 509 | 2939 ... 3256 | 2479 |
| FCBBF30100080 | 510 | 1237 ... 1656 | 2480 |
| FCBBF30100120 | 511 | 8 ... 2305 | 2481 |
| FCBBF30100410 | 512 | 121 ... 1374 | 2482 |
| FCBBF30101240 | 513 | 1696 ... 2382 | 2483 |
| FCBBF30101300 | 514 | 3802 ... > 4413 | 2484 |
| FCBBF30105080 | 515 | 973 ... 1836 | 2485 |
| FCBBF30105440 | 516 | 1354 ... 2040 | 2486 |
| FCBBF30105860 | 517 | 355 ... > 2524 | 2487 |
| FCBBF30106950 | 518 | 192 ... 944 | 2488 |
| FCBBF30107290 | 519 | 1002 ... 1610 | 2489 |
| FCBBF30107330 | 520 | 703 ... 1071 | 2490 |
| FCBBF30114180 | 521 | 1777 ... 2289 | 2491 |
| FCBBF30114850 | 522 | 769 ... 1503 | 2492 |
| FCBBF30115230 | 523 | 417 ... 755 | 2493 |
| FCBBF30115920 | 524 | 543 ... 1802 | 2494 |
| FCBBF30118670 | 525 | 891 ... 2807 | 2495 |
| FCBBF30118890 | 526 | 184 ... > 2630 | 2496 |
| FCBBF30125460 | 527 | 67 ... 1926 | 2497 |
| FCBBF30125880 | 528 | 185 ... 670 | 2498 |
| FCBBF30128420 | 529 | 1789 ... 2130 | 2499 |
| FCBBF30129010 | 530 | 184 ... 1236 | 2500 |
| FCBBF30130410 | 531 | 1149 ... 1874 | 2501 |
| FCBBF30130580 | 532 | 156 ... 2123 | 2502 |
| FCBBF30132050 | 533 | 718 ... 1854 | 2503 |
| FCBBF30132660 | 534 | 86 ... 1051 | 2504 |
| FCBBF30135890 | 535 | 214 ... > 2483 | 2505 |
| FCBBF30136230 | 536 | 24 ... 3338 | 2506 |
| FCBBF30138000 | 537 | 646 ... 2901 | 2507 |
| FCBBF30142290 | 538 | 679 ... 1662 | 2508 |
| FCBBF30143550 | 539 | 111 ... 3191 | 2509 |
| FCBBF30145670 | 540 | 1533 ... 1880 | 2510 |
| FCBBF30151190 | 541 | 974 ... 1312 | 2511 |
| FCBBF30153170 | 542 | 16 ... 2307 | 2512 |
| FCBBF30157270 | 543 | 84 ... > 3303 | 2513 |
| FCBBF30161780 | 544 | 21 ... 659 | 2514 |
| FCBBF30164510 | 545 | 561 ... 3035 | 2515 |
| FCBBF30166220 | 546 | 178 ... 483 | 2516 |
| FCBBF30169280 | 547 | 116 ... 901 | 2517 |
| FCBBF30169870 | 548 | 102 ... 407 | 2518 |
| FCBBF30170710 | 549 | 8 ... 382 | 2519 |
| FCBBF30171230 | 550 | 1735 ... 2361 | 2520 |
| FCBBF30172330 | 551 | 2497 ... 2952 | 2521 |
| FCBBF30173960 | 552 | 106 ... > 3530 | 2522 |
| FCBBF30175350 | 553 | 2 ... 721 | 2523 |
| FCBBF30177290 | 554 | 378 ... 923 | 2524 |
| FCBBF30179180 | 555 | 2382 ... > 3452 | 2525 |
| FCBBF30179740 | 556 | 299 ... 721 | 2526 |
| FCBBF30181730 | 557 | 43 ... 351 | 2527 |
| FCBBF30194370 | 558 | 698 ... 1057 | 2528 |
| FCBBF30194550 | 559 | 9 ... 1982 | 2529 |
| FCBBF30195690 | 560 | 15 ... 1682 | 2530 |
| FCBBF30195700 | 561 | 14 ... 376 | 2531 |
| FCBBF30197840 | 562 | 406 ... 3015 | 2532 |
| FCBBF30198670 | 563 | 421 ... 2733 | 2533 |
| FCBBF30201630 | 564 | 1407 ... 2561 | 2534 |
| FCBBF30212210 | 565 | 1669 ... 2502 | 2535 |
| FCBBF30215240 | 566 | 774 ... 1586 | 2536 |
| FCBBF30220050 | 567 | 1431 ... 2006 | 2537 |
| FCBBF30222910 | 568 | 117 ... 614 | 2538 |
| FCBBF30223110 | 569 | 647 ... 1129 | 2539 |
| FCBBF30223210 | 570 | 141 ... 680 | 2540 |
| FCBBF30225930 | 571 | 166 ... 1956 | 2541 |
| FCBBF30228940 | 572 | 79 ... 453 | 2542 |
| FCBBF30230610 | 573 | 99 ... 440 | 2543 |
| FCBBF30236670 | 574 | 1889 ... 2719 | 2544 |
| FCBBF30250980 | 575 | 214 ... 2514 | 2545 |
| FCBBF30255680 | 576 | 27 ... > 2480 | 2546 |
| FCBBF30257370 | 577 | 2 ... 1873 | 2547 |
| FCBBF30259050 | 578 | 104 ... 1600 | 2548 |
| FCBBF30260210 | 579 | 115 ... > 2494 | 2549 |
| FCBBF30260480 | 580 | 28 ... 519 | 2550 |
| FCBBF30263080 | 581 | 535 ... 900 | 2551 |
| FCBBF30266510 | 582 | 445 ... 3378 | 2552 |
| FCBBF30271990 | 583 | 187 ... 1704 | 2553 |
| FCBBF30275590 | 584 | 51 ... > 2374 | 2554 |
| FCBBF30282020 | 585 | 123 ... 1721 | 2555 |
| FCBBF30285930 | 586 | 260 ... 697 | 2556 |
| FCBBF30287940 | 587 | 1636 ... 2079 | 2557 |
| FCBBF40000610 | 588 | 586 ... 1131 | 2558 |
| FCBBF40001920 | 589 | 753 ... 1082 | 2559 |
| FCBBF40005000 | 590 | 57 ... 446 | 2560 |
| FCBBF50000410 | 591 | 930 ... 1256 | 2561 |
| FCBBF50000610 | 592 | 383 ... 697 | 2562 |
| FCBBF50001650 | 593 | 562 ... 1815 | 2563 |
| FCBBF50003530 | 594 | 127 ... 921 | 2564 |
| FCBBF50004950 | 595 | 2156 ... 2545 | 2565 |
| FEBRA20005040 | 596 | 295 ... 2100 | 2566 |
| FEBRA20007820 | 597 | 160 ... 690 | 2567 |
| FEBRA20018670 | 598 | 184 ... 1077 | 2568 |
| FEBRA20026820 | 599 | 103 ... 1836 | 2569 |
| FEBRA20027070 | 600 | 663 ... 1736 | 2570 |
| FEBRA20029620 | 601 | 565 ... 1206 | 2571 |
| FEBRA20031000 | 602 | 380 ... 2551 | 2572 |
| FEBRA20031150 | 603 | 2925 ... 3293 | 2573 |
| FEBRA20031280 | 604 | 362 ... 3124 | 2574 |
| FEBRA20031810 | 605 | 1093 ... 1455 | 2575 |
| FEBRA20035200 | 606 | 2607 ... 3215 | 2576 |
| FEBRA20035240 | 607 | 74 ... 826 | 2577 |
| FEBRA20038220 | 608 | 157 ... 1305 | 2578 |
| FEBRA20038330 | 609 | 1612 ... 2253 | 2579 |
| FEBRA20038970 | 610 | 1279 ... 2811 | 2580 |
| FEBRA20039070 | 611 | 967 ... 1575 | 2581 |
| FEBRA20039260 | 612 | 23 ... 685 | 2582 |
| FEBRA20040230 | 613 | 1663 ... 2076 | 2583 |
| FEBRA20040260 | 614 | 244 ... 561 | 2584 |
| FEBRA20040290 | 615 | 1488 ... 2330 | 2585 |
| FEBRA20040560 | 616 | 711 ... 1496 | 2586 |
| FEBRA20045380 | 617 | 81 ... 398 | 2587 |
| FEBRA20046200 | 618 | 125 ... 2062 | 2588 |
| FEBRA20046280 | 619 | 694 ... 1017 | 2589 |
| FEBRA20046510 | 620 | 859 ... 2256 | 2590 |
| FEBRA20057010 | 621 | 757 ... 1107 | 2591 |
| FEBRA20063720 | 622 | 118 ... 1878 | 2592 |
| FEBRA20076200 | 623 | 303 ... 680 | 2593 |
| FEBRA20078180 | 624 | 1517 ... 1888 | 2594 |
| FEBRA20078800 | 625 | 24 ... 644 | 2595 |
| FEBRA20080860 | 626 | 584 ... 2419 | 2596 |
| FEBRA20082660 | 627 | 114 ... 1793 | 2597 |
| FEBRA20083410 | 628 | 1169 ... 1561 | 2598 |
| FEBRA20084750 | 629 | 888 ... 1202 | 2599 |
| FEBRA20086600 | 630 | 670 ... 1407 | 2600 |
| FEBRA20087550 | 631 | 1140 ... 1814 | 2601 |
| FEBRA20088610 | 632 | 315 ... 818 | 2602 |
| FEBRA20088810 | 633 | 1302 ... 2021 | 2603 |
| FEBRA20090160 | 634 | 1 ... 732 | 2604 |
| FEBRA20090220 | 635 | 106 ... 2271 | 2605 |
| FEBRA20091620 | 636 | 1528 ... 1935 | 2606 |
| FEBRA20092760 | 637 | 694 ... 1317 | 2607 |
| FEBRA20093270 | 638 | 2205 ... 2507 | 2608 |
| FEBRA20093280 | 639 | 2165 ... 2485 | 2609 |
| FEBRA20095410 | 640 | 267 ... 647 | 2610 |
| FEBRA20098040 | 641 | 43 ... 459 | 2611 |
| FEBRA20099860 | 642 | 55 ... 573 | 2612 |
| FEBRA20101410 | 643 | 396 ... 740 | 2613 |
| FEBRA20108020 | 644 | 181 ... 492 | 2614 |
| FEBRA20108580 | 645 | 542 ... 901 | 2615 |
| FEBRA20115930 | 646 | 58 ... 1494 | 2616 |
| FEBRA20116650 | 647 | 178 ... 573 | 2617 |
| FEBRA20121200 | 648 | 972 ... 1490 | 2618 |
| FEBRA20121950 | 649 | 1217 ... 1723 | 2619 |
| FEBRA20141980 | 650 | 644 ... 955 | 2620 |
| FEBRA20150420 | 651 | 314 ... 3124 | 2621 |

TABLE 1-continued

| Clone name | SEQ ID NO. of nucleotide sequence | Position of CDS | SEQ ID NO. of amino acid sequence |
|---|---|---|---|
| FEBRA20151750 | 652 | 52 . . . > 2299 | 2622 |
| FEBRA20163980 | 653 | 93 . . . 1223 | 2623 |
| FEBRA20170240 | 654 | 385 . . . 1632 | 2624 |
| FEBRA20172230 | 655 | 377 . . . 1363 | 2625 |
| FEBRA20173330 | 656 | 462 . . . 2378 | 2626 |
| FEBRA20175020 | 657 | 2040 . . . 2438 | 2627 |
| FEBRA20175330 | 658 | 62 . . . 520 | 2628 |
| FEBRA20177800 | 659 | 1918 . . . 2289 | 2629 |
| FEBRA20180510 | 660 | 350 . . . 889 | 2630 |
| FEBRA20182030 | 661 | 341 . . . 745 | 2631 |
| FEBRA20187460 | 662 | 395 . . . 736 | 2632 |
| FEBRA20191720 | 663 | 417 . . . 836 | 2633 |
| HCHON10000150 | 664 | 197 . . . 670 | 2634 |
| HCHON10001660 | 665 | 913 . . . 1338 | 2635 |
| HCHON20000870 | 666 | 442 . . . 1857 | 2636 |
| HCHON20002650 | 667 | 4 . . . 792 | 2637 |
| HCHON20002710 | 668 | 169 . . . 1437 | 2638 |
| HCHON20015050 | 669 | 529 . . . 1995 | 2639 |
| HEART10001420 | 670 | 4 . . . 1476 | 2640 |
| HEART10001490 | 671 | 159 . . . 1121 | 2641 |
| HEART20009590 | 672 | 1369 . . . 1938 | 2642 |
| HEART20019310 | 673 | 47 . . . 1693 | 2643 |
| HEART20022200 | 674 | 11 . . . 1378 | 2644 |
| HEART20031680 | 675 | 1033 . . . 3018 | 2645 |
| HEART20047640 | 676 | 595 . . . 2904 | 2646 |
| HEART20063100 | 677 | 131 . . . 826 | 2647 |
| HEART20082570 | 678 | 18 . . . 1022 | 2648 |
| HHDPC10001140 | 679 | 506 . . . 1102 | 2649 |
| HHDPC20051850 | 680 | 21 . . . 422 | 2650 |
| HHDPC20081230 | 681 | 132 . . . 2195 | 2651 |
| HHDPC20082790 | 682 | 150 . . . 608 | 2652 |
| HHDPC20082970 | 683 | 1445 . . . 1771 | 2653 |
| HHDPC20088160 | 684 | 214 . . . > 2639 | 2654 |
| HLUNG20008460 | 685 | 157 . . . 1818 | 2655 |
| HLUNG20009260 | 686 | 1035 . . . 1856 | 2656 |
| HLUNG20009550 | 687 | 16 . . . 657 | 2657 |
| HLUNG20010130 | 688 | 1083 . . . 1400 | 2658 |
| HLUNG20011260 | 689 | 135 . . . 479 | 2659 |
| HLUNG20011440 | 690 | 803 . . . 1207 | 2660 |
| HLUNG20011460 | 691 | 43 . . . 1587 | 2661 |
| HLUNG20012140 | 692 | 188 . . . 508 | 2662 |
| HLUNG20014590 | 693 | 1015 . . . > 2241 | 2663 |
| HLUNG20015070 | 694 | 377 . . . 1945 | 2664 |
| HLUNG20015180 | 695 | 468 . . . 1808 | 2665 |
| HLUNG20020500 | 696 | 1232 . . . 1687 | 2666 |
| HLUNG20020850 | 697 | 802 . . . 1179 | 2667 |
| HLUNG20021450 | 698 | 753 . . . 1109 | 2668 |
| HLUNG20023030 | 699 | 2466 . . . 2855 | 2669 |
| HLUNG20024050 | 700 | 651 . . . 1568 | 2670 |
| HLUNG20025620 | 701 | 1424 . . . 1765 | 2671 |
| HLUNG20028110 | 702 | 164 . . . 1996 | 2672 |
| HLUNG20029420 | 703 | 160 . . . 774 | 2673 |
| HLUNG20029490 | 704 | 135 . . . 563 | 2674 |
| HLUNG20030420 | 705 | 116 . . . 1906 | 2675 |
| HLUNG20030490 | 706 | 553 . . . 1608 | 2676 |
| HLUNG20030610 | 707 | 920 . . . 1465 | 2677 |
| HLUNG20031620 | 708 | 604 . . . 1038 | 2678 |
| HLUNG20032460 | 709 | 29 . . . 1582 | 2679 |
| HLUNG20033060 | 710 | 1085 . . . > 2287 | 2680 |
| HLUNG20033310 | 711 | 1319 . . . 1654 | 2681 |
| HLUNG20033350 | 712 | 1035 . . . > 2205 | 2682 |
| HLUNG20034970 | 713 | 1046 . . . 1747 | 2683 |
| HLUNG20037140 | 714 | 1342 . . . 1698 | 2684 |
| HLUNG20037160 | 715 | 1704 . . . 3152 | 2685 |
| HLUNG20037780 | 716 | 1190 . . . 1855 | 2686 |
| HLUNG20038330 | 717 | 433 . . . 1284 | 2687 |
| HLUNG20041540 | 718 | 199 . . . 1542 | 2688 |
| HLUNG20041590 | 719 | 130 . . . > 2341 | 2689 |
| HLUNG20042730 | 720 | 150 . . . 1484 | 2690 |
| HLUNG20045340 | 721 | 189 . . . 608 | 2691 |
| HLUNG20047070 | 722 | 1310 . . . 1672 | 2692 |
| HLUNG20050760 | 723 | 1813 . . . 2118 | 2693 |
| HLUNG20051330 | 724 | 55 . . . > 2821 | 2694 |
| HLUNG20052300 | 725 | 88 . . . 1008 | 2695 |
| HLUNG20054790 | 726 | 1418 . . . 2548 | 2696 |
| HLUNG20055240 | 727 | 204 . . . 554 | 2697 |
| HLUNG20056560 | 728 | 6 . . . 512 | 2698 |
| HLUNG20057380 | 729 | 303 . . . 788 | 2699 |
| HLUNG20059240 | 730 | 1529 . . . 1870 | 2700 |
| HLUNG20060670 | 731 | 753 . . . 1517 | 2701 |
| HLUNG20063700 | 732 | 1356 . . . 1685 | 2702 |
| HLUNG20065700 | 733 | 90 . . . 911 | 2703 |
| HLUNG20065990 | 734 | 344 . . . 1231 | 2704 |
| HLUNG20067810 | 735 | 178 . . . 639 | 2705 |
| HLUNG20068120 | 736 | 853 . . . 1281 | 2706 |
| HLUNG20069350 | 737 | 198 . . . 1871 | 2707 |
| HLUNG20070410 | 738 | 474 . . . 929 | 2708 |
| HLUNG20072100 | 739 | 164 . . . 1879 | 2709 |
| HLUNG20072190 | 740 | 1394 . . . 1723 | 2710 |
| HLUNG20072450 | 741 | 127 . . . 468 | 2711 |
| HLUNG20074330 | 742 | 1621 . . . > 1976 | 2712 |
| HLUNG20079310 | 743 | 1484 . . . 2050 | 2713 |
| HLUNG20081390 | 744 | 123 . . . 1910 | 2714 |
| HLUNG20081530 | 745 | 1218 . . . 1889 | 2715 |
| HLUNG20082350 | 746 | 313 . . . 2109 | 2716 |
| HLUNG20083330 | 747 | 770 . . . 1138 | 2717 |
| HLUNG20083480 | 748 | 183 . . . 1895 | 2718 |
| HLUNG20083840 | 749 | 1389 . . . 1811 | 2719 |
| HLUNG20083960 | 750 | 1214 . . . 1630 | 2720 |
| HLUNG20084790 | 751 | 1185 . . . 1745 | 2721 |
| HLUNG20085210 | 752 | 138 . . . 779 | 2722 |
| HLUNG20088750 | 753 | 1321 . . . 1635 | 2723 |
| HLUNG20092530 | 754 | 224 . . . 577 | 2724 |
| HLUNG20093030 | 755 | 1836 . . . 2246 | 2725 |
| HLUNG20094130 | 756 | 2129 . . . 2554 | 2726 |
| KIDNE20011600 | 757 | 197 . . . 601 | 2727 |
| KIDNE20016360 | 758 | 81 . . . 2798 | 2728 |
| KIDNE20024380 | 759 | 1017 . . . > 1994 | 2729 |
| KIDNE20027980 | 760 | 329 . . . 1891 | 2730 |
| KIDNE20080690 | 761 | 1 . . . 1500 | 2731 |
| KIDNE20081170 | 762 | 1356 . . . 2444 | 2732 |
| KIDNE20083150 | 763 | 863 . . . 1342 | 2733 |
| KIDNE20083620 | 764 | 216 . . . 1142 | 2734 |
| KIDNE20084030 | 765 | 28 . . . 1572 | 2735 |
| KIDNE20084040 | 766 | 318 . . . 926 | 2736 |
| KIDNE20084730 | 767 | 580 . . . 2511 | 2737 |
| KIDNE20084800 | 768 | 9 . . . 332 | 2738 |
| KIDNE20086490 | 769 | 162 . . . 1919 | 2739 |
| KIDNE20086660 | 770 | 341 . . . 700 | 2740 |
| KIDNE20086970 | 771 | 202 . . . 846 | 2741 |
| KIDNE20087880 | 772 | 668 . . . 1003 | 2742 |
| KIDNE20088240 | 773 | 101 . . . 1135 | 2743 |
| KIDNE20089870 | 774 | 212 . . . 1621 | 2744 |
| KIDNE20091090 | 775 | 272 . . . 670 | 2745 |
| KIDNE20094260 | 776 | 125 . . . 442 | 2746 |
| KIDNE20094670 | 777 | 997 . . . 2232 | 2747 |
| KIDNE20095530 | 778 | 1573 . . . > 1878 | 2748 |
| KIDNE20133460 | 779 | 210 . . . > 1556 | 2749 |
| KIDNE20133880 | 780 | 743 . . . 1057 | 2750 |
| KIDNE20134130 | 781 | 174 . . . 797 | 2751 |
| KIDNE20134890 | 782 | 384 . . . 923 | 2752 |
| KIDNE20137310 | 783 | 304 . . . 876 | 2753 |
| KIDNE20138450 | 784 | 499 . . . 828 | 2754 |
| KIDNE20140870 | 785 | 750 . . . > 3206 | 2755 |
| KIDNE20141120 | 786 | 1387 . . . 1932 | 2756 |
| KIDNE20141700 | 787 | 1825 . . . 2286 | 2757 |
| KIDNE20142680 | 788 | 796 . . . 1239 | 2758 |
| KIDNE20142900 | 789 | 45 . . . 764 | 2759 |
| KIDNE20143200 | 790 | 982 . . . 1452 | 2760 |
| KIDNE20147170 | 791 | 1017 . . . 1493 | 2761 |
| KIDNE20148080 | 792 | 1097 . . . 1675 | 2762 |
| KIDNE20149780 | 793 | 267 . . . 1370 | 2763 |
| KIDNE20150730 | 794 | 1671 . . . 1991 | 2764 |
| KIDNE20152440 | 795 | 3 . . . 1346 | 2765 |
| KIDNE20154330 | 796 | 422 . . . 2713 | 2766 |
| KIDNE20154830 | 797 | 1588 . . . 1923 | 2767 |
| KIDNE20155980 | 798 | 1164 . . . 1595 | 2768 |
| KIDNE20157100 | 799 | 90 . . . 1286 | 2769 |
| KIDNE20160360 | 800 | 413 . . . 2692 | 2770 |
| KIDNE20160960 | 801 | 10 . . . 534 | 2771 |

TABLE 1-continued

| Clone name | SEQ ID NO. of nucleotide sequence | Position of CDS | SEQ ID NO. of amino acid sequence |
|---|---|---|---|
| KIDNE20163710 | 802 | 1605 ... 1973 | 2772 |
| KIDNE20165390 | 803 | 68 ... 2341 | 2773 |
| KIDNE20169180 | 804 | 125 ... 2146 | 2774 |
| KIDNE20170400 | 805 | 597 ... 2192 | 2775 |
| KIDNE20173150 | 806 | 51 ... 1052 | 2776 |
| KIDNE20173430 | 807 | 136 ... 1296 | 2777 |
| KIDNE20176030 | 808 | 2418 ... 2879 | 2778 |
| KIDNE20181670 | 809 | 180 ... 659 | 2779 |
| KIDNE20182540 | 810 | 135 ... 1745 | 2780 |
| KIDNE20186170 | 811 | 83 ... 748 | 2781 |
| KIDNE20188630 | 812 | 519 ... 926 | 2782 |
| KIDNE20189890 | 813 | 1834 ... 2445 | 2783 |
| KIDNE20189960 | 814 | 284 ... 1666 | 2784 |
| KIDNE20191870 | 815 | 860 ... 1372 | 2785 |
| LIVER20006260 | 816 | 379 ... 1668 | 2786 |
| LIVER20007690 | 817 | 329 ... 760 | 2787 |
| LIVER20007750 | 818 | 176 ... 1549 | 2788 |
| LIVER20010510 | 819 | 757 ... 1143 | 2789 |
| LIVER20010760 | 820 | 95 ... 838 | 2790 |
| LIVER20010990 | 821 | 305 ... 1009 | 2791 |
| LIVER20011640 | 822 | 1187 ... 2086 | 2792 |
| LIVER20013890 | 823 | 1528 ... 2199 | 2793 |
| LIVER20026440 | 824 | 1019 ... 1963 | 2794 |
| LIVER20030650 | 825 | 1469 ... 2239 | 2795 |
| LIVER20032340 | 826 | 2181 ... 2504 | 2796 |
| LIVER20038000 | 827 | 78 ... 1004 | 2797 |
| LIVER20040740 | 828 | 195 ... 1370 | 2798 |
| LIVER20055270 | 829 | 148 ... 1347 | 2799 |
| MESAN20006200 | 830 | 2690 ... 3235 | 2800 |
| MESAN20007110 | 831 | 1401 ... 1823 | 2801 |
| MESAN20008150 | 832 | 136 ... 3567 | 2802 |
| MESAN20008940 | 833 | 122 ... 514 | 2803 |
| MESAN20009090 | 834 | 247 ... 1992 | 2804 |
| MESAN20016270 | 835 | 346 ... 2031 | 2805 |
| MESAN20021130 | 836 | 1540 ... 2676 | 2806 |
| MESAN20021220 | 837 | 94 ... 2322 | 2807 |
| MESAN20021470 | 838 | 658 ... 1446 | 2808 |
| MESAN20021860 | 839 | 217 ... 1113 | 2809 |
| MESAN20026870 | 840 | 63 ... 2450 | 2810 |
| MESAN20027240 | 841 | 39 ... 1940 | 2811 |
| MESAN20027900 | 842 | 212 ... 3322 | 2812 |
| MESAN20029780 | 843 | 1900 ... 2331 | 2813 |
| MESAN20030350 | 844 | 142 ... > 2239 | 2814 |
| MESAN20030370 | 845 | 735 ... 2462 | 2815 |
| MESAN20030390 | 846 | 3 ... 389 | 2816 |
| MESAN20033220 | 847 | 68 ... 478 | 2817 |
| MESAN20034440 | 848 | 42 ... 2183 | 2818 |
| MESAN20038520 | 849 | 31 ... 2547 | 2819 |
| MESAN20041380 | 850 | 7 ... 342 | 2820 |
| MESAN20045750 | 851 | 145 ... 1002 | 2821 |
| MESAN20056890 | 852 | 187 ... 1125 | 2822 |
| MESAN20057240 | 853 | 101 ... 778 | 2823 |
| MESAN20058110 | 854 | 174 ... 1022 | 2824 |
| MESAN20059570 | 855 | 280 ... 1782 | 2825 |
| MESAN20060220 | 856 | 464 ... 775 | 2826 |
| MESAN20060430 | 857 | 1589 ... 3469 | 2827 |
| MESAN20065990 | 858 | 213 ... 533 | 2828 |
| MESAN20067430 | 859 | 1287 ... 1973 | 2829 |
| MESAN20069530 | 860 | 336 ... > 3472 | 2830 |
| MESAN20084150 | 861 | 78 ... 665 | 2831 |
| MESAN20085360 | 862 | 1168 ... 1656 | 2832 |
| MESAN20089260 | 863 | 169 ... 1254 | 2833 |
| MESAN20090190 | 864 | 256 ... 2898 | 2834 |
| MESAN20094180 | 865 | 1696 ... 2139 | 2835 |
| MESAN20095220 | 866 | 1118 ... 1972 | 2836 |
| MESAN20095800 | 867 | 31 ... 1137 | 2837 |
| NESOP20004520 | 868 | 109 ... 1512 | 2838 |
| NESOP20005040 | 869 | 316 ... 1308 | 2839 |
| NT2NE20018740 | 870 | 1413 ... 1772 | 2840 |
| NT2NE20018890 | 871 | 39 ... 1061 | 2841 |
| NT2NE20021860 | 872 | 268 ... 1653 | 2842 |
| NT2NE20026200 | 873 | 1888 ... 2907 | 2843 |
| NT2NE20026510 | 874 | 338 ... 1381 | 2844 |
| NT2NE20028700 | 875 | 166 ... 1377 | 2845 |
| NT2NE20033150 | 876 | 496 ... 912 | 2846 |
| NT2NE20037050 | 877 | 19 ... 411 | 2847 |
| NT2NE20038870 | 878 | 190 ... 1548 | 2848 |
| NT2NE20039210 | 879 | 226 ... 639 | 2849 |
| NT2NE20042550 | 880 | 708 ... 1568 | 2850 |
| NT2NE20045190 | 881 | 33 ... 599 | 2851 |
| NT2NE20047870 | 882 | 314 ... 1207 | 2852 |
| NT2NE20053230 | 883 | 622 ... 1068 | 2853 |
| NT2NE20053950 | 884 | 133 ... 993 | 2854 |
| NT2NE20059210 | 885 | 35 ... 391 | 2855 |
| NT2NE20059680 | 886 | 120 ... 443 | 2856 |
| NT2NE20060750 | 887 | 239 ... 928 | 2857 |
| NT2NE20061030 | 888 | 160 ... 600 | 2858 |
| NT2NE20062880 | 889 | 201 ... 539 | 2859 |
| NT2NE20064780 | 890 | 284 ... 1771 | 2860 |
| NT2NE20066590 | 891 | 821 ... 1204 | 2861 |
| NT2NE20069580 | 892 | 1404 ... 2282 | 2862 |
| NT2NE20070520 | 893 | 347 ... 661 | 2863 |
| NT2NE20073650 | 894 | 756 ... 1088 | 2864 |
| NT2NE20077250 | 895 | 1815 ... 3185 | 2865 |
| NT2NE20077270 | 896 | 250 ... > 3642 | 2866 |
| NT2NE20077860 | 897 | 589 ... 1053 | 2867 |
| NT2NE20079670 | 898 | 404 ... 1867 | 2868 |
| NT2NE20080770 | 899 | 1181 ... 1483 | 2869 |
| NT2NE20082130 | 900 | 1026 ... 1457 | 2870 |
| NT2NE20082600 | 901 | 688 ... 1227 | 2871 |
| NT2NE20086070 | 902 | 503 ... 823 | 2872 |
| NT2NE20087270 | 903 | 276 ... 1709 | 2873 |
| NT2NE20087850 | 904 | 9 ... 326 | 2874 |
| NT2NE20088030 | 905 | 682 ... 1023 | 2875 |
| NT2NE20092950 | 906 | 142 ... 1884 | 2876 |
| NT2NE20095230 | 907 | 547 ... 1602 | 2877 |
| NT2NE20104000 | 908 | 217 ... 702 | 2878 |
| NT2NE20107810 | 909 | 29 ... 376 | 2879 |
| NT2NE20108420 | 910 | 1135 ... > 2525 | 2880 |
| NT2NE20111190 | 911 | 202 ... 651 | 2881 |
| NT2NE20112210 | 912 | 963 ... 2231 | 2882 |
| NT2NE20114850 | 913 | 1441 ... > 1794 | 2883 |
| NT2NE20117580 | 914 | 271 ... 912 | 2884 |
| NT2NE20119980 | 915 | 445 ... 843 | 2885 |
| NT2NE20123610 | 916 | 118 ... 717 | 2886 |
| NT2NE20124570 | 917 | 1279 ... 1620 | 2887 |
| NT2NE20126030 | 918 | 1054 ... 1548 | 2888 |
| NT2NE20127900 | 919 | 85 ... 1599 | 2889 |
| NT2NE20140130 | 920 | 355 ... 753 | 2890 |
| NT2NE20140280 | 921 | 126 ... 989 | 2891 |
| NT2NE20141040 | 922 | 53 ... 811 | 2892 |
| NT2NE20145250 | 923 | 94 ... 531 | 2893 |
| NT2NE20146510 | 924 | 125 ... 661 | 2894 |
| NT2NE20148690 | 925 | 544 ... 861 | 2895 |
| NT2NE20149500 | 926 | 454 ... 888 | 2896 |
| NT2NE20150610 | 927 | 73 ... 432 | 2897 |
| NT2NE20152620 | 928 | 1080 ... 2516 | 2898 |
| NT2NE20153620 | 929 | 133 ... 1512 | 2899 |
| NT2NE20155650 | 930 | 716 ... 1210 | 2900 |
| NT2NE20157120 | 931 | 927 ... 1271 | 2901 |
| NT2NE20165190 | 932 | 85 ... 531 | 2902 |
| NT2NE20167660 | 933 | 20 ... 349 | 2903 |
| NT2NE20173970 | 934 | 274 ... > 2188 | 2904 |
| NT2NE20177210 | 935 | 115 ... 675 | 2905 |
| NT2NE20181760 | 936 | 201 ... 785 | 2906 |
| NT2NE20181800 | 937 | 784 ... 1137 | 2907 |
| NT2NE20184720 | 938 | 1033 ... 1506 | 2908 |
| NT2RI20016240 | 939 | 359 ... 748 | 2909 |
| NT2RI20021200 | 940 | 534 ... 875 | 2910 |
| NT2RI20033920 | 941 | 269 ... 1444 | 2911 |
| NT2RI20093010 | 942 | 1478 ... 1816 | 2912 |
| NT2RP70001120 | 943 | 172 ... 1518 | 2913 |
| NT2RP70001730 | 944 | 166 ... 1935 | 2914 |
| NT2RP70003110 | 945 | 15 ... 1868 | 2915 |
| NT2RP70012830 | 946 | 280 ... 2337 | 2916 |
| NT2RP70022820 | 947 | 2819 ... > 3760 | 2917 |
| NT2RP70027790 | 948 | 389 ... 2965 | 2918 |
| NT2RP70029780 | 949 | 156 ... 1349 | 2919 |
| NT2RP70030840 | 950 | 278 ... 2983 | 2920 |
| NT2RP70031070 | 951 | 148 ... 1740 | 2921 |

TABLE 1-continued

| Clone name | SEQ ID NO. of nucleotide sequence | Position of CDS | SEQ ID NO. of amino acid sequence |
|---|---|---|---|
| NT2RP70031340 | 952 | 107 . . . 1576 | 2922 |
| NT2RP70031480 | 953 | 203 . . . 2947 | 2923 |
| NT2RP70035110 | 954 | 106 . . . 765 | 2924 |
| NT2RP70046410 | 955 | 155 . . . 1582 | 2925 |
| NT2RP70049610 | 956 | 834 . . . 1889 | 2926 |
| NT2RP70056290 | 957 | 2748 . . . 3182 | 2927 |
| NT2RP70056690 | 958 | 253 . . . > 3053 | 2928 |
| NT2RP70057500 | 959 | 216 . . . 2615 | 2929 |
| NT2RP70064570 | 960 | 636 . . . 2162 | 2930 |
| NT2RP70074800 | 961 | 199 . . . 684 | 2931 |
| NT2RP70075300 | 962 | 226 . . . 1539 | 2932 |
| NT2RP70075800 | 963 | 211 . . . 3801 | 2933 |
| NT2RP70080150 | 964 | 306 . . . 674 | 2934 |
| NT2RP70084540 | 965 | 8 . . . 406 | 2935 |
| NT2RP70087140 | 966 | 175 . . . 1074 | 2936 |
| NT2RP70090870 | 967 | 272 . . . 2617 | 2937 |
| NTONG20002230 | 968 | 50 . . . > 3211 | 2938 |
| NTONG20005310 | 969 | 88 . . . 471 | 2939 |
| NTONG20017620 | 970 | 40 . . . 432 | 2940 |
| NTONG20029850 | 971 | 110 . . . 1258 | 2941 |
| NTONG20031580 | 972 | 126 . . . 863 | 2942 |
| NTONG20032100 | 973 | 65 . . . 1132 | 2943 |
| NTONG20034540 | 974 | 163 . . . 2523 | 2944 |
| NTONG20035150 | 975 | 543 . . . 2477 | 2945 |
| NTONG20043080 | 976 | 22 . . . 2679 | 2946 |
| NTONG20048440 | 977 | 89 . . . 1849 | 2947 |
| NTONG20049180 | 978 | 155 . . . 1300 | 2948 |
| NTONG20053630 | 979 | 321 . . . 3821 | 2949 |
| NTONG20053730 | 980 | 121 . . . 1701 | 2950 |
| NTONG20053910 | 981 | 47 . . . 2758 | 2951 |
| NTONG20055200 | 982 | 122 . . . 1969 | 2952 |
| NTONG20058010 | 983 | 237 . . . 1559 | 2953 |
| NTONG20058220 | 984 | 67 . . . 1314 | 2954 |
| OCBBF20000740 | 985 | 165 . . . 2402 | 2955 |
| OCBBF20001780 | 986 | 1990 . . . 2334 | 2956 |
| OCBBF20005220 | 987 | 590 . . . 2299 | 2957 |
| OCBBF20009820 | 988 | 281 . . . 823 | 2958 |
| OCBBF20011860 | 989 | 145 . . . 528 | 2959 |
| OCBBF20012520 | 990 | 786 . . . 3023 | 2960 |
| OCBBF20016390 | 991 | 667 . . . 1617 | 2961 |
| OCBBF20016810 | 992 | 123 . . . 2351 | 2962 |
| OCBBF20109450 | 993 | 204 . . . 506 | 2963 |
| OCBBF20109780 | 994 | 253 . . . 573 | 2964 |
| OCBBF20110210 | 995 | 8 . . . 1072 | 2965 |
| OCBBF20110730 | 996 | 1346 . . . 1666 | 2966 |
| OCBBF20111370 | 997 | 296 . . . 1345 | 2967 |
| OCBBF20111600 | 998 | 375 . . . 1823 | 2968 |
| OCBBF20112280 | 999 | 447 . . . 860 | 2969 |
| OCBBF20112320 | 1000 | 72 . . . 857 | 2970 |
| OCBBF20113110 | 1001 | 292 . . . 738 | 2971 |
| OCBBF20115360 | 1002 | 1182 . . . 2126 | 2972 |
| OCBBF20116250 | 1003 | 124 . . . 2175 | 2973 |
| OCBBF20117220 | 1004 | 605 . . . 937 | 2974 |
| OCBBF20118720 | 1005 | 131 . . . 451 | 2975 |
| OCBBF20119810 | 1006 | 1483 . . . 2478 | 2976 |
| OCBBF20120010 | 1007 | 216 . . . 1106 | 2977 |
| OCBBF20120950 | 1008 | 91 . . . 1629 | 2978 |
| OCBBF20121910 | 1009 | 235 . . . 2580 | 2979 |
| OCBBF20123200 | 1010 | 1046 . . . 1411 | 2980 |
| OCBBF20142290 | 1011 | 94 . . . 900 | 2981 |
| OCBBF20147070 | 1012 | 1193 . . . 3256 | 2982 |
| OCBBF20152330 | 1013 | 284 . . . 613 | 2983 |
| OCBBF20155030 | 1014 | 188 . . . 724 | 2984 |
| OCBBF20156450 | 1015 | 104 . . . 1132 | 2985 |
| OCBBF20157970 | 1016 | 1390 . . . 2313 | 2986 |
| OCBBF20160380 | 1017 | 1176 . . . 3884 | 2987 |
| OCBBF20165900 | 1018 | 407 . . . 934 | 2988 |
| OCBBF20165910 | 1019 | 1260 . . . 2495 | 2989 |
| OCBBF20166890 | 1020 | 201 . . . 1121 | 2990 |
| OCBBF20166900 | 1021 | 350 . . . > 2606 | 2991 |
| OCBBF20167290 | 1022 | 186 . . . 2858 | 2992 |
| OCBBF20170350 | 1023 | 8 . . . 499 | 2993 |
| OCBBF20174580 | 1024 | 179 . . . 1294 | 2994 |
| OCBBF20174890 | 1025 | 178 . . . 1380 | 2995 |
| OCBBF20175360 | 1026 | 1394 . . . 1711 | 2996 |
| OCBBF20176650 | 1027 | 121 . . . 423 | 2997 |
| OCBBF20177540 | 1028 | 334 . . . 1242 | 2998 |
| OCBBF20177910 | 1029 | 1047 . . . 1688 | 2999 |
| OCBBF20182060 | 1030 | 964 . . . 1827 | 3000 |
| OCBBF20185630 | 1031 | 1839 . . . 2195 | 3001 |
| OCBBF20188280 | 1032 | 322 . . . 696 | 3002 |
| OCBBF20191950 | 1033 | 47 . . . 2305 | 3003 |
| PANCR10000860 | 1034 | 20 . . . 376 | 3004 |
| PEBLM10001470 | 1035 | 155 . . . 1960 | 3005 |
| PEBLM20001800 | 1036 | 59 . . . 1549 | 3006 |
| PEBLM20003260 | 1037 | 660 . . . 1121 | 3007 |
| PEBLM20005020 | 1038 | 315 . . . 647 | 3008 |
| PLACE50001290 | 1039 | 620 . . . 1030 | 3009 |
| PLACE50001390 | 1040 | 156 . . . 1376 | 3010 |
| PLACE60001910 | 1041 | 1521 . . . 2252 | 3011 |
| PLACE60004260 | 1042 | 562 . . . 924 | 3012 |
| PLACE60006300 | 1043 | 12 . . . 725 | 3013 |
| PLACE60011180 | 1044 | 526 . . . 894 | 3014 |
| PLACE60012620 | 1045 | 106 . . . 1368 | 3015 |
| PLACE60017120 | 1046 | 1116 . . . 1454 | 3016 |
| PLACE60052940 | 1047 | 385 . . . > 2108 | 3017 |
| PLACE60053280 | 1048 | 161 . . . > 2687 | 3018 |
| PLACE60054230 | 1049 | 189 . . . 1550 | 3019 |
| PLACE60054820 | 1050 | 298 . . . 852 | 3020 |
| PLACE60054870 | 1051 | 105 . . . 2213 | 3021 |
| PLACE60055350 | 1052 | 1188 . . . 1562 | 3022 |
| PLACE60055460 | 1053 | 160 . . . 1197 | 3023 |
| PLACE60055590 | 1054 | 123 . . . 1406 | 3024 |
| PLACE60056910 | 1055 | 1028 . . . 1549 | 3025 |
| PLACE60057860 | 1056 | 1617 . . . 1940 | 3026 |
| PLACE60061370 | 1057 | 1 . . . 1899 | 3027 |
| PLACE60062660 | 1058 | 97 . . . 954 | 3028 |
| PLACE60062870 | 1059 | 604 . . . 1278 | 3029 |
| PLACE60063940 | 1060 | 459 . . . 797 | 3030 |
| PLACE60064180 | 1061 | 167 . . . 1240 | 3031 |
| PLACE60064740 | 1062 | 302 . . . 952 | 3032 |
| PLACE60066970 | 1063 | 697 . . . 1998 | 3033 |
| PLACE60068710 | 1064 | 363 . . . 1139 | 3034 |
| PLACE60069880 | 1065 | 898 . . . 1374 | 3035 |
| PLACE60070500 | 1066 | 765 . . . 1718 | 3036 |
| PLACE60071800 | 1067 | 689 . . . 1333 | 3037 |
| PLACE60072390 | 1068 | 145 . . . 522 | 3038 |
| PLACE60072420 | 1069 | 289 . . . 684 | 3039 |
| PLACE60073090 | 1070 | 384 . . . 1814 | 3040 |
| PLACE60074820 | 1071 | 38 . . . 727 | 3041 |
| PLACE60077870 | 1072 | 2280 . . . 2609 | 3042 |
| PLACE60080360 | 1073 | 285 . . . 938 | 3043 |
| PLACE60081260 | 1074 | 1192 . . . 1860 | 3044 |
| PLACE60082850 | 1075 | 665 . . . 1132 | 3045 |
| PLACE60087680 | 1076 | 3 . . . 836 | 3046 |
| PLACE60088240 | 1077 | 94 . . . 570 | 3047 |
| PLACE60092280 | 1078 | 180 . . . 869 | 3048 |
| PLACE60092370 | 1079 | 371 . . . 691 | 3049 |
| PLACE60093380 | 1080 | 433 . . . 1335 | 3050 |
| PLACE60095240 | 1081 | 956 . . . 1312 | 3051 |
| PLACE60095600 | 1082 | 4 . . . > 2605 | 3052 |
| PLACE60098350 | 1083 | 86 . . . 1852 | 3053 |
| PLACE60104630 | 1084 | 1267 . . . 1671 | 3054 |
| PLACE60105680 | 1085 | 1290 . . . 1631 | 3055 |
| PLACE60107010 | 1086 | 128 . . . 829 | 3056 |
| PLACE60109910 | 1087 | 4 . . . 567 | 3057 |
| PLACE60113340 | 1088 | 127 . . . 1518 | 3058 |
| PLACE60118810 | 1089 | 101 . . . 1657 | 3059 |
| PLACE60119700 | 1090 | 199 . . . 516 | 3060 |
| PLACE60120280 | 1091 | 61 . . . 705 | 3061 |
| PLACE60122970 | 1092 | 861 . . . > 1396 | 3062 |
| PLACE60132200 | 1093 | 240 . . . 1082 | 3063 |
| PLACE60132320 | 1094 | 471 . . . 1121 | 3064 |
| PLACE60132880 | 1095 | 495 . . . 1406 | 3065 |
| PLACE60138840 | 1096 | 729 . . . 1553 | 3066 |
| PLACE60140640 | 1097 | 840 . . . 1919 | 3067 |
| PLACE60150510 | 1098 | 215 . . . 1246 | 3068 |
| PLACE60154450 | 1099 | 25 . . . 873 | 3069 |
| PLACE60155910 | 1100 | 255 . . . 701 | 3070 |
| PLACE60157310 | 1101 | 1156 . . . 1482 | 3071 |

TABLE 1-continued

| Clone name | SEQ ID NO. of nucleotide sequence | Position of CDS | SEQ ID NO. of amino acid sequence |
|---|---|---|---|
| PLACE60162100 | 1102 | 885 ... 1226 | 3072 |
| PLACE60175640 | 1103 | 242 ... 556 | 3073 |
| PLACE60177880 | 1104 | 104 ... 1327 | 3074 |
| PLACE60177910 | 1105 | 59 ... 442 | 3075 |
| PLACE60181870 | 1106 | 131 ... 673 | 3076 |
| PLACE60184410 | 1107 | 995 ... 1483 | 3077 |
| PLACE60184870 | 1108 | 86 ... > 1402 | 3078 |
| PLACE60188630 | 1109 | 571 ... 1395 | 3079 |
| PROST10001100 | 1110 | 716 ... 1219 | 3080 |
| PROST10001360 | 1111 | 1506 ... 1997 | 3081 |
| PROST10002150 | 1112 | 840 ... 2345 | 3082 |
| PROST20007170 | 1113 | 216 ... 1679 | 3083 |
| PROST20007600 | 1114 | 29 ... 742 | 3084 |
| PROST20011160 | 1115 | 150 ... 548 | 3085 |
| PROST20011800 | 1116 | 1297 ... 1629 | 3086 |
| PROST20014140 | 1117 | 1901 ... 3022 | 3087 |
| PROST20014150 | 1118 | 1632 ... 1961 | 3088 |
| PROST20014650 | 1119 | 1243 ... 1653 | 3089 |
| PROST20015210 | 1120 | 711 ... 1499 | 3090 |
| PROST20015400 | 1121 | 49 ... 399 | 3091 |
| PROST20016760 | 1122 | 62 ... 1870 | 3092 |
| PROST20022120 | 1123 | 301 ... 762 | 3093 |
| PROST20024250 | 1124 | 38 ... 445 | 3094 |
| PROST20028970 | 1125 | 30 ... 821 | 3095 |
| PROST20033240 | 1126 | 39 ... 1682 | 3096 |
| PROST20035170 | 1127 | 689 ... 1078 | 3097 |
| PROST20035830 | 1128 | 1154 ... 1468 | 3098 |
| PROST20036280 | 1129 | 1801 ... 2295 | 3099 |
| PROST20036350 | 1130 | 22 ... 2175 | 3100 |
| PROST20039300 | 1131 | 87 ... 635 | 3101 |
| PROST20041460 | 1132 | 427 ... 855 | 3102 |
| PROST20042700 | 1133 | 461 ... 1081 | 3103 |
| PROST20045700 | 1134 | 472 ... 975 | 3104 |
| PROST20047440 | 1135 | 1058 ... 1441 | 3105 |
| PROST20048170 | 1136 | 73 ... 555 | 3106 |
| PROST20050390 | 1137 | 1358 ... 2035 | 3107 |
| PROST20051310 | 1138 | 1913 ... 2737 | 3108 |
| PROST20052720 | 1139 | 1195 ... 1515 | 3109 |
| PROST20052850 | 1140 | 430 ... 1185 | 3110 |
| PROST20054660 | 1141 | 55 ... 753 | 3111 |
| PROST20058860 | 1142 | 506 ... 892 | 3112 |
| PROST20060200 | 1143 | 103 ... 429 | 3113 |
| PROST20062820 | 1144 | 415 ... 1215 | 3114 |
| PROST20063430 | 1145 | 126 ... 1199 | 3115 |
| PROST20065100 | 1146 | 95 ... 1522 | 3116 |
| PROST20065790 | 1147 | 225 ... 2555 | 3117 |
| PROST20073280 | 1148 | 891 ... 1277 | 3118 |
| PROST20075280 | 1149 | 97 ... 885 | 3119 |
| PROST20078710 | 1150 | 347 ... 1213 | 3120 |
| PROST20082430 | 1151 | 2077 ... 2436 | 3121 |
| PROST20084470 | 1152 | 728 ... 1498 | 3122 |
| PROST20084680 | 1153 | 395 ... 733 | 3123 |
| PROST20084720 | 1154 | 1528 ... 1839 | 3124 |
| PROST20087240 | 1155 | 766 ... 1452 | 3125 |
| PROST20093470 | 1156 | 1288 ... 1647 | 3126 |
| PROST20094000 | 1157 | 376 ... 1011 | 3127 |
| PROST20097310 | 1158 | 1502 ... 1903 | 3128 |
| PROST20097360 | 1159 | 99 ... 602 | 3129 |
| PROST20097840 | 1160 | 687 ... 1289 | 3130 |
| PROST20099090 | 1161 | 85 ... 792 | 3131 |
| PROST20102190 | 1162 | 86 ... 406 | 3132 |
| PROST20102500 | 1163 | 1467 ... 2051 | 3133 |
| PROST20103820 | 1164 | 1770 ... 2078 | 3134 |
| PROST20105450 | 1165 | 1027 ... 1911 | 3135 |
| PROST20106060 | 1166 | 97 ... 705 | 3136 |
| PROST20108850 | 1167 | 1173 ... 1664 | 3137 |
| PROST20110120 | 1168 | 804 ... 1139 | 3138 |
| PROST20114100 | 1169 | 74 ... 772 | 3139 |
| PROST20120070 | 1170 | 442 ... 1593 | 3140 |
| PROST20121570 | 1171 | 673 ... 1185 | 3141 |
| PROST20122490 | 1172 | 10 ... 753 | 3142 |
| PROST20124000 | 1173 | 943 ... 1371 | 3143 |
| PROST20125420 | 1174 | 1480 ... 1968 | 3144 |
| PROST20127450 | 1175 | 255 ... 857 | 3145 |
| PROST20130320 | 1176 | 549 ... 2309 | 3146 |
| PROST20138730 | 1177 | 494 ... 829 | 3147 |
| PROST20146590 | 1178 | 618 ... 2351 | 3148 |
| PROST20151370 | 1179 | 99 ... 482 | 3149 |
| PROST20152510 | 1180 | 1095 ... 2168 | 3150 |
| PROST20152870 | 1181 | 258 ... 1322 | 3151 |
| PROST20155370 | 1182 | 606 ... 2255 | 3152 |
| PROST20156360 | 1183 | 1557 ... 1898 | 3153 |
| PROST20159320 | 1184 | 67 ... 567 | 3154 |
| PROST20168600 | 1185 | 336 ... 1700 | 3155 |
| PUAEN10000650 | 1186 | 341 ... 943 | 3156 |
| PUAEN10000870 | 1187 | 1676 ... 2029 | 3157 |
| PUAEN10001640 | 1188 | 332 ... 1138 | 3158 |
| PUAEN20000800 | 1189 | 327 ... 1811 | 3159 |
| PUAEN20001520 | 1190 | 155 ... 1243 | 3160 |
| PUAEN20002470 | 1191 | 3 ... 2417 | 3161 |
| PUAEN20003120 | 1192 | 93 ... 2216 | 3162 |
| SALGL10001070 | 1193 | 89 ... 997 | 3163 |
| SKMUS20006790 | 1194 | 389 ... 1330 | 3164 |
| SKMUS20007260 | 1195 | 47 ... > 1320 | 3165 |
| SKMUS20008730 | 1196 | 91 ... 1407 | 3166 |
| SKMUS20017400 | 1197 | 84 ... 815 | 3167 |
| SKMUS20020770 | 1198 | 179 ... 781 | 3168 |
| SKMUS20026340 | 1199 | 57 ... 1202 | 3169 |
| SKMUS20040440 | 1200 | 27 ... 1091 | 3170 |
| SKMUS20046810 | 1201 | 91 ... 459 | 3171 |
| SKMUS20073150 | 1202 | 17 ... > 822 | 3172 |
| SKMUS20073590 | 1203 | 438 ... 824 | 3173 |
| SKMUS20079150 | 1204 | 165 ... 1235 | 3174 |
| SKMUS20091900 | 1205 | 57 ... 359 | 3175 |
| SKNMC10001230 | 1206 | 87 ... 1814 | 3176 |
| SKNMC20006350 | 1207 | 326 ... 1738 | 3177 |
| SKNSH10001010 | 1208 | 1189 ... 1530 | 3178 |
| SKNSH20007160 | 1209 | 113 ... 562 | 3179 |
| SKNSH20009710 | 1210 | 71 ... 622 | 3180 |
| SKNSH20030640 | 1211 | 1635 ... 2090 | 3181 |
| SKNSH20040390 | 1212 | 246 ... 911 | 3182 |
| SKNSH20052400 | 1213 | 926 ... 2017 | 3183 |
| SKNSH20057920 | 1214 | 369 ... 1352 | 3184 |
| SKNSH20068220 | 1215 | 504 ... 1235 | 3185 |
| SKNSH20094350 | 1216 | 70 ... 591 | 3186 |
| SMINT20000070 | 1217 | 752 ... 1858 | 3187 |
| SMINT20002320 | 1218 | 607 ... 1761 | 3188 |
| SMINT20006020 | 1219 | 1215 ... 2348 | 3189 |
| SMINT20006090 | 1220 | 75 ... 602 | 3190 |
| SMINT20007470 | 1221 | 154 ... 1650 | 3191 |
| SMINT20008110 | 1222 | 784 ... 1557 | 3192 |
| SMINT20011830 | 1223 | 34 ... 447 | 3193 |
| SMINT20011950 | 1224 | 732 ... 2006 | 3194 |
| SMINT20012220 | 1225 | 239 ... 616 | 3195 |
| SMINT20013970 | 1226 | 1117 ... 1686 | 3196 |
| SMINT20014610 | 1227 | 287 ... 814 | 3197 |
| SMINT20016150 | 1228 | 911 ... 1675 | 3198 |
| SMINT20017310 | 1229 | 1220 ... 1561 | 3199 |
| SMINT20021260 | 1230 | 1066 ... 1407 | 3200 |
| SMINT20023110 | 1231 | 1696 ... 2073 | 3201 |
| SMINT20024140 | 1232 | 31 ... 555 | 3202 |
| SMINT20026200 | 1233 | 323 ... 2170 | 3203 |
| SMINT20028800 | 1234 | 476 ... 1696 | 3204 |
| SMINT20028840 | 1235 | 89 ... 823 | 3205 |
| SMINT20030740 | 1236 | 172 ... 1833 | 3206 |
| SMINT20031280 | 1237 | 542 ... 1489 | 3207 |
| SMINT20035050 | 1238 | 227 ... 2149 | 3208 |
| SMINT20035510 | 1239 | 168 ... > 1891 | 3209 |
| SMINT20036440 | 1240 | 207 ... 2084 | 3210 |
| SMINT20038660 | 1241 | 289 ... 1449 | 3211 |
| SMINT20039050 | 1242 | 175 ... > 2338 | 3212 |
| SMINT20043390 | 1243 | 1465 ... 2094 | 3213 |
| SMINT20044140 | 1244 | 30 ... 1718 | 3214 |
| SMINT20044730 | 1245 | 45 ... 1787 | 3215 |
| SMINT20045470 | 1246 | 1156 ... 1539 | 3216 |
| SMINT20045830 | 1247 | 287 ... 1882 | 3217 |
| SMINT20045890 | 1248 | 893 ... 1372 | 3218 |
| SMINT20047290 | 1249 | 2 ... 637 | 3219 |
| SMINT20048720 | 1250 | 1834 ... > 2374 | 3220 |
| SMINT20049920 | 1251 | 1384 ... 1860 | 3221 |

TABLE 1-continued

| Clone name | SEQ ID NO. of nucleotide sequence | Position of CDS | SEQ ID NO. of amino acid sequence |
|---|---|---|---|
| SMINT20052130 | 1252 | 271 . . . 891 | 3222 |
| SMINT20054050 | 1253 | 361 . . . 1839 | 3223 |
| SMINT20056230 | 1254 | 73 . . . 1674 | 3224 |
| SMINT20056240 | 1255 | 1108 . . . 1533 | 3225 |
| SMINT20062050 | 1256 | 75 . . . 1964 | 3226 |
| SMINT20067080 | 1257 | 138 . . . 2075 | 3227 |
| SMINT20070620 | 1258 | 44 . . . 445 | 3228 |
| SMINT20074330 | 1259 | 71 . . . 532 | 3229 |
| SMINT20077920 | 1260 | 843 . . . 1166 | 3230 |
| SMINT20077960 | 1261 | 1010 . . . 2467 | 3231 |
| SMINT20081330 | 1262 | 250 . . . 618 | 3232 |
| SMINT20083290 | 1263 | 80 . . . 1606 | 3233 |
| SMINT20084910 | 1264 | 664 . . . 987 | 3234 |
| SMINT20085310 | 1265 | 129 . . . 500 | 3235 |
| SMINT20085450 | 1266 | 66 . . . 437 | 3236 |
| SMINT20086250 | 1267 | 1958 . . . 2287 | 3237 |
| SMINT20086720 | 1268 | 233 . . . 1003 | 3238 |
| SMINT20088440 | 1269 | 31 . . . 438 | 3239 |
| SMINT20088690 | 1270 | 26 . . . 580 | 3240 |
| SMINT20089210 | 1271 | 1259 . . . 1672 | 3241 |
| SMINT20089600 | 1272 | 241 . . . 1335 | 3242 |
| SMINT20091190 | 1273 | 290 . . . 1765 | 3243 |
| SMINT20092120 | 1274 | 33 . . . 416 | 3244 |
| SMINT20092160 | 1275 | 439 . . . 780 | 3245 |
| SMINT20093630 | 1276 | 1822 . . . 2241 | 3246 |
| SMINT20094150 | 1277 | 511 . . . 966 | 3247 |
| SMINT20094680 | 1278 | 36 . . . 452 | 3248 |
| SPLEN20005160 | 1279 | 2342 . . . 2659 | 3249 |
| SPLEN20005370 | 1280 | 1497 . . . 1856 | 3250 |
| SPLEN20006950 | 1281 | 702 . . . 1343 | 3251 |
| SPLEN20011350 | 1282 | 1127 . . . 1537 | 3252 |
| SPLEN20012450 | 1283 | 134 . . . 442 | 3253 |
| SPLEN20015030 | 1284 | 376 . . . 945 | 3254 |
| SPLEN20015100 | 1285 | 1367 . . . 2137 | 3255 |
| SPLEN20016500 | 1286 | 328 . . . 816 | 3256 |
| SPLEN20017610 | 1287 | 940 . . . 1314 | 3257 |
| SPLEN20017810 | 1288 | 101 . . . 556 | 3258 |
| SPLEN20019120 | 1289 | 176 . . . 487 | 3259 |
| SPLEN20020530 | 1290 | 358 . . . 762 | 3260 |
| SPLEN20023430 | 1291 | 1067 . . . 1426 | 3261 |
| SPLEN20023540 | 1292 | 644 . . . 1903 | 3262 |
| SPLEN20023850 | 1293 | 467 . . . > 1879 | 3263 |
| SPLEN20024190 | 1294 | 319 . . . 1368 | 3264 |
| SPLEN20024510 | 1295 | 1070 . . . 1423 | 3265 |
| SPLEN20024620 | 1296 | 3 . . . 1514 | 3266 |
| SPLEN20024770 | 1297 | 134 . . . 2353 | 3267 |
| SPLEN20024930 | 1298 | 1150 . . . 3069 | 3268 |
| SPLEN20029170 | 1299 | 67 . . . 750 | 3269 |
| SPLEN20036780 | 1300 | 1432 . . . 1752 | 3270 |
| SPLEN20039180 | 1301 | 359 . . . 1534 | 3271 |
| SPLEN20040780 | 1302 | 1675 . . . 2346 | 3272 |
| SPLEN20041810 | 1303 | 801 . . . 1142 | 3273 |
| SPLEN20042200 | 1304 | 1123 . . . 1935 | 3274 |
| SPLEN20043430 | 1305 | 224 . . . 565 | 3275 |
| SPLEN20043460 | 1306 | 55 . . . 1899 | 3276 |
| SPLEN20043680 | 1307 | 1337 . . . 2371 | 3277 |
| SPLEN20045550 | 1308 | 5 . . . 1513 | 3278 |
| SPLEN20048800 | 1309 | 2038 . . . 2352 | 3279 |
| SPLEN20049840 | 1310 | 82 . . . 3378 | 3280 |
| SPLEN20050090 | 1311 | 418 . . . 2202 | 3281 |
| SPLEN20051420 | 1312 | 685 . . . 1983 | 3282 |
| SPLEN20054160 | 1313 | 186 . . . 2069 | 3283 |
| SPLEN20054500 | 1314 | 667 . . . 1443 | 3284 |
| SPLEN20055600 | 1315 | 146 . . . 1033 | 3285 |
| SPLEN20057830 | 1316 | 507 . . . 1163 | 3286 |
| SPLEN20057900 | 1317 | 1883 . . . 2431 | 3287 |
| SPLEN20058180 | 1318 | 803 . . . 1120 | 3288 |
| SPLEN20059270 | 1319 | 162 . . . 1586 | 3289 |
| SPLEN20062830 | 1320 | 282 . . . 785 | 3290 |
| SPLEN20063250 | 1321 | 315 . . . 1535 | 3291 |
| SPLEN20063890 | 1322 | 133 . . . 996 | 3292 |
| SPLEN20067010 | 1323 | 2702 . . . > 3023 | 3293 |
| SPLEN20071820 | 1324 | 876 . . . 1592 | 3294 |
| SPLEN20073500 | 1325 | 174 . . . 2210 | 3295 |
| SPLEN20073880 | 1326 | 220 . . . 2595 | 3296 |
| SPLEN20076190 | 1327 | 20 . . . 331 | 3297 |
| SPLEN20076470 | 1328 | 575 . . . 1714 | 3298 |
| SPLEN20080070 | 1329 | 5 . . . 1339 | 3299 |
| SPLEN20081640 | 1330 | 946 . . . 1308 | 3300 |
| SPLEN20085910 | 1331 | 1084 . . . 1434 | 3301 |
| SPLEN20087370 | 1332 | 2670 . . . 3098 | 3302 |
| SPLEN20087860 | 1333 | 255 . . . 755 | 3303 |
| SPLEN20090880 | 1334 | 1742 . . . 2194 | 3304 |
| SPLEN20098030 | 1335 | 268 . . . 1077 | 3305 |
| SPLEN20100040 | 1336 | 101 . . . 862 | 3306 |
| SPLEN20101950 | 1337 | 122 . . . 1198 | 3307 |
| SPLEN20104150 | 1338 | 1146 . . . 2219 | 3308 |
| SPLEN20104690 | 1339 | 661 . . . 990 | 3309 |
| SPLEN20105100 | 1340 | 1425 . . . 1859 | 3310 |
| SPLEN20108000 | 1341 | 887 . . . 1351 | 3311 |
| SPLEN20108460 | 1342 | 2254 . . . 2607 | 3312 |
| SPLEN20110180 | 1343 | 147 . . . 1292 | 3313 |
| SPLEN20110210 | 1344 | 1831 . . . 2271 | 3314 |
| SPLEN20110860 | 1345 | 1489 . . . 1887 | 3315 |
| SPLEN20111450 | 1346 | 2768 . . . 3208 | 3316 |
| SPLEN20114190 | 1347 | 154 . . . 1440 | 3317 |
| SPLEN20116720 | 1348 | 9 . . . 1583 | 3318 |
| SPLEN20117580 | 1349 | 218 . . . 1240 | 3319 |
| SPLEN20118050 | 1350 | 145 . . . 1122 | 3320 |
| SPLEN20121790 | 1351 | 569 . . . 1054 | 3321 |
| SPLEN20125230 | 1352 | 971 . . . 1324 | 3322 |
| SPLEN20126110 | 1353 | 254 . . . 991 | 3323 |
| SPLEN20135030 | 1354 | 40 . . . 1848 | 3324 |
| SPLEN20136700 | 1355 | 1296 . . . 1628 | 3325 |
| SPLEN20136730 | 1356 | 1312 . . . 1644 | 3326 |
| SPLEN20137530 | 1357 | 2676 . . . 3221 | 3327 |
| SPLEN20138600 | 1358 | 1166 . . . 1582 | 3328 |
| SPLEN20139100 | 1359 | 63 . . . 1532 | 3329 |
| SPLEN20139360 | 1360 | 763 . . . 1827 | 3330 |
| SPLEN20175920 | 1361 | 1123 . . . 1590 | 3331 |
| SPLEN20176130 | 1362 | 16 . . . 549 | 3332 |
| SPLEN20177400 | 1363 | 1078 . . . 1431 | 3333 |
| SPLEN20180980 | 1364 | 410 . . . 823 | 3334 |
| SPLEN20181570 | 1365 | 214 . . . > 2609 | 3335 |
| SPLEN20182850 | 1366 | 168 . . . 659 | 3336 |
| SPLEN20182990 | 1367 | 55 . . . 1881 | 3337 |
| SPLEN20183020 | 1368 | 265 . . . 723 | 3338 |
| SPLEN20183950 | 1369 | 402 . . . 746 | 3339 |
| SPLEN20187490 | 1370 | 98 . . . > 2458 | 3340 |
| SPLEN20190080 | 1371 | 914 . . . 1342 | 3341 |
| SPLEN20190430 | 1372 | 884 . . . > 1942 | 3342 |
| SPLEN20190770 | 1373 | 97 . . . 771 | 3343 |
| SPLEN20191020 | 1374 | 140 . . . 1426 | 3344 |
| SPLEN20192570 | 1375 | 325 . . . 654 | 3345 |
| SPLEN20193230 | 1376 | 253 . . . 588 | 3346 |
| SPLEN20193490 | 1377 | 321 . . . 854 | 3347 |
| SPLEN20193750 | 1378 | 845 . . . 1306 | 3348 |
| SPLEN20193790 | 1379 | 290 . . . 2278 | 3349 |
| SPLEN20195710 | 1380 | 64 . . . 516 | 3350 |
| SPLEN20197090 | 1381 | 11 . . . 550 | 3351 |
| SPLEN20197740 | 1382 | 2 . . . 499 | 3352 |
| SPLEN20197930 | 1383 | 803 . . . > 1625 | 3353 |
| SPLEN20198390 | 1384 | 14 . . . 1873 | 3354 |
| SPLEN20199850 | 1385 | 575 . . . 1009 | 3355 |
| SPLEN20200070 | 1386 | 353 . . . 655 | 3356 |
| SPLEN20200340 | 1387 | 1047 . . . 1814 | 3357 |
| SPLEN20201830 | 1388 | 143 . . . 1177 | 3358 |
| SPLEN20203590 | 1389 | 160 . . . 471 | 3359 |
| SPLEN20204670 | 1390 | 6 . . . 311 | 3360 |
| SPLEN20205120 | 1391 | 682 . . . 1542 | 3361 |
| TESOP10000350 | 1392 | 1646 . . . 2101 | 3362 |
| TESOP10001600 | 1393 | 282 . . . 1352 | 3363 |
| TESTI10000190 | 1394 | 84 . . . 2042 | 3364 |
| TESTI10000850 | 1395 | 925 . . . 1311 | 3365 |
| TESTI10001570 | 1396 | 141 . . . 1919 | 3366 |
| TESTI20004310 | 1397 | 55 . . . 2484 | 3367 |
| TESTI20005980 | 1398 | 1350 . . . > 1866 | 3368 |
| TESTI20006160 | 1399 | 53 . . . 1720 | 3369 |
| TESTI20006830 | 1400 | 313 . . . 1719 | 3370 |
| TESTI20012080 | 1401 | 89 . . . 1867 | 3371 |

TABLE 1-continued

| Clone name | SEQ ID NO. of nucleotide sequence | Position of CDS | SEQ ID NO. of amino acid sequence |
|---|---|---|---|
| TESTI20012360 | 1402 | 178 ... 594 | 3372 |
| TESTI20016970 | 1403 | 133 ... 1842 | 3373 |
| TESTI20019590 | 1404 | 210 ... 752 | 3374 |
| TESTI20028020 | 1405 | 201 ... 1298 | 3375 |
| TESTI20029100 | 1406 | 1743 ... 2147 | 3376 |
| TESTI20030200 | 1407 | 94 ... 2091 | 3377 |
| TESTI20030440 | 1408 | 60 ... 1931 | 3378 |
| TESTI20030610 | 1409 | 547 ... 1371 | 3379 |
| TESTI20031310 | 1410 | 889 ... 2235 | 3380 |
| TESTI20031410 | 1411 | 201 ... 1655 | 3381 |
| TESTI20032770 | 1412 | 163 ... 1002 | 3382 |
| TESTI20034750 | 1413 | 472 ... 804 | 3383 |
| TESTI20035330 | 1414 | 13 ... 558 | 3384 |
| TESTI20035790 | 1415 | 16 ... 2163 | 3385 |
| TESTI20038240 | 1416 | 163 ... 2502 | 3386 |
| TESTI20040850 | 1417 | 52 ... 669 | 3387 |
| TESTI20041630 | 1418 | 330 ... 1526 | 3388 |
| TESTI20043130 | 1419 | 410 ... 715 | 3389 |
| TESTI20043180 | 1420 | 68 ... 2515 | 3390 |
| TESTI20043220 | 1421 | 1496 ... 1957 | 3391 |
| TESTI20043910 | 1422 | 37 ... 1728 | 3392 |
| TESTI20043990 | 1423 | 311 ... 1153 | 3393 |
| TESTI20044900 | 1424 | 234 ... 1595 | 3394 |
| TESTI20045390 | 1425 | 156 ... 2108 | 3395 |
| TESTI20045740 | 1426 | 199 ... 549 | 3396 |
| TESTI20046110 | 1427 | 24 ... 1826 | 3397 |
| TESTI20046490 | 1428 | 554 ... 2542 | 3398 |
| TESTI20046540 | 1429 | 123 ... 2309 | 3399 |
| TESTI20046870 | 1430 | 278 ... 1645 | 3400 |
| TESTI20046890 | 1431 | 276 ... 2702 | 3401 |
| TESTI20047370 | 1432 | 2 ... 2134 | 3402 |
| TESTI20047930 | 1433 | 239 ... 1843 | 3403 |
| TESTI20049060 | 1434 | 1191 ... 1784 | 3404 |
| TESTI20049410 | 1435 | 281 ... 2170 | 3405 |
| TESTI20049990 | 1436 | 355 ... 915 | 3406 |
| TESTI20050170 | 1437 | 314 ... 808 | 3407 |
| TESTI20050400 | 1438 | 111 ... 440 | 3408 |
| TESTI20050720 | 1439 | 68 ... 1621 | 3409 |
| TESTI20051200 | 1440 | 1561 ... 2145 | 3410 |
| TESTI20051730 | 1441 | 183 ... 1943 | 3411 |
| TESTI20052670 | 1442 | 759 ... 1910 | 3412 |
| TESTI20053070 | 1443 | 98 ... 1285 | 3413 |
| TESTI20053260 | 1444 | 456 ... 842 | 3414 |
| TESTI20053780 | 1445 | 176 ... 1948 | 3415 |
| TESTI20053800 | 1446 | 42 ... 1694 | 3416 |
| TESTI20053950 | 1447 | 528 ... > 1782 | 3417 |
| TESTI20054700 | 1448 | 19 ... 1956 | 3418 |
| TESTI20055680 | 1449 | 53 ... 1510 | 3419 |
| TESTI20055880 | 1450 | 127 ... 1644 | 3420 |
| TESTI20056030 | 1451 | 543 ... 1658 | 3421 |
| TESTI20057200 | 1452 | 279 ... 611 | 3422 |
| TESTI20057430 | 1453 | 131 ... 1858 | 3423 |
| TESTI20057590 | 1454 | 37 ... 1062 | 3424 |
| TESTI20057840 | 1455 | 180 ... 1271 | 3425 |
| TESTI20057880 | 1456 | 39 ... 1697 | 3426 |
| TESTI20058350 | 1457 | 25 ... 1368 | 3427 |
| TESTI20058920 | 1458 | 108 ... 1088 | 3428 |
| TESTI20059080 | 1459 | 2134 ... 3069 | 3429 |
| TESTI20059330 | 1460 | 540 ... 845 | 3430 |
| TESTI20059370 | 1461 | 655 ... 1137 | 3431 |
| TESTI20059480 | 1462 | 52 ... 1362 | 3432 |
| TESTI20059790 | 1463 | 203 ... 1336 | 3433 |
| TESTI20059810 | 1464 | 324 ... > 1914 | 3434 |
| TESTI20060080 | 1465 | 172 ... 858 | 3435 |
| TESTI20060150 | 1466 | 383 ... 1663 | 3436 |
| TESTI20060350 | 1467 | 81 ... 1427 | 3437 |
| TESTI20060450 | 1468 | 1306 ... 1752 | 3438 |
| TESTI20060830 | 1469 | 54 ... 2543 | 3439 |
| TESTI20061090 | 1470 | 382 ... 798 | 3440 |
| TESTI20061200 | 1471 | 382 ... 1938 | 3441 |
| TESTI20062120 | 1472 | 37 ... 1632 | 3442 |
| TESTI20062180 | 1473 | 169 ... 1413 | 3443 |
| TESTI20062580 | 1474 | 863 ... 1165 | 3444 |
| TESTI20063330 | 1475 | 1334 ... 1678 | 3445 |
| TESTI20063410 | 1476 | 2175 ... 2501 | 3446 |
| TESTI20063600 | 1477 | 1399 ... 1809 | 3447 |
| TESTI20064370 | 1478 | 201 ... 1706 | 3448 |
| TESTI20064530 | 1479 | 68 ... 2737 | 3449 |
| TESTI20064650 | 1480 | 353 ... 2542 | 3450 |
| TESTI20064990 | 1481 | 733 ... 1290 | 3451 |
| TESTI20065650 | 1482 | 374 ... 1609 | 3452 |
| TESTI20066150 | 1483 | 98 ... 2473 | 3453 |
| TESTI20066170 | 1484 | 143 ... 1309 | 3454 |
| TESTI20066280 | 1485 | 100 ... 879 | 3455 |
| TESTI20066330 | 1486 | 26 ... 1528 | 3456 |
| TESTI20066590 | 1487 | 306 ... 740 | 3457 |
| TESTI20066650 | 1488 | 415 ... 1362 | 3458 |
| TESTI20067350 | 1489 | 342 ... 1073 | 3459 |
| TESTI20067440 | 1490 | 196 ... 1887 | 3460 |
| TESTI20067480 | 1491 | 127 ... 1758 | 3461 |
| TESTI20068530 | 1492 | 791 ... 1369 | 3462 |
| TESTI20068790 | 1493 | 1033 ... > 1738 | 3463 |
| TESTI20068940 | 1494 | 55 ... > 1867 | 3464 |
| TESTI20070400 | 1495 | 147 ... 2300 | 3465 |
| TESTI20070740 | 1496 | 743 ... 1480 | 3466 |
| TESTI20071130 | 1497 | 224 ... 1738 | 3467 |
| TESTI20071630 | 1498 | 38 ... 727 | 3468 |
| TESTI20073460 | 1499 | 97 ... 1584 | 3469 |
| TESTI20075240 | 1500 | 259 ... 1686 | 3470 |
| TESTI20076570 | 1501 | 622 ... 1110 | 3471 |
| TESTI20076920 | 1502 | 90 ... 608 | 3472 |
| TESTI20079060 | 1503 | 105 ... 2096 | 3473 |
| TESTI20079220 | 1504 | 54 ... 2252 | 3474 |
| TESTI20079980 | 1505 | 62 ... 1300 | 3475 |
| TESTI20080460 | 1506 | 1458 ... 1787 | 3476 |
| TESTI20081890 | 1507 | 184 ... 2520 | 3477 |
| TESTI20083890 | 1508 | 1102 ... 1596 | 3478 |
| TESTI20084250 | 1509 | 386 ... 2035 | 3479 |
| TESTI20085670 | 1510 | 1459 ... 2001 | 3480 |
| TESTI20086840 | 1511 | 10 ... 1488 | 3481 |
| TESTI20088840 | 1512 | 172 ... 1587 | 3482 |
| TESTI20089290 | 1513 | 26 ... 421 | 3483 |
| TESTI20090180 | 1514 | 527 ... 1657 | 3484 |
| TESTI20090970 | 1515 | 548 ... 2308 | 3485 |
| TESTI20091360 | 1516 | 745 ... 1230 | 3486 |
| TESTI20092170 | 1517 | 882 ... 1256 | 3487 |
| TESTI20093900 | 1518 | 265 ... 1791 | 3488 |
| TESTI20094620 | 1519 | 1897 ... 2319 | 3489 |
| TESTI20095200 | 1520 | 94 ... 1149 | 3490 |
| TESTI20095440 | 1521 | 1134 ... 1496 | 3491 |
| TESTI20095770 | 1522 | 278 ... > 2225 | 3492 |
| TESTI20095880 | 1523 | 144 ... 1775 | 3493 |
| TESTI20097270 | 1524 | 157 ... 693 | 3494 |
| TESTI20099350 | 1525 | 123 ... > 1773 | 3495 |
| TESTI20100090 | 1526 | 1020 ... 2057 | 3496 |
| TESTI20102390 | 1527 | 1873 ... 2247 | 3497 |
| TESTI20103690 | 1528 | 71 ... 1048 | 3498 |
| TESTI20104090 | 1529 | 364 ... 1716 | 3499 |
| TESTI20105130 | 1530 | 320 ... 1966 | 3500 |
| TESTI20105910 | 1531 | 151 ... 2265 | 3501 |
| TESTI20106170 | 1532 | 235 ... 1338 | 3502 |
| TESTI20106820 | 1533 | 1191 ... 1604 | 3503 |
| TESTI20107240 | 1534 | 163 ... 2844 | 3504 |
| TESTI20107320 | 1535 | 377 ... 787 | 3505 |
| TESTI20107340 | 1536 | 1229 ... 1723 | 3506 |
| TESTI20108060 | 1537 | 371 ... 925 | 3507 |
| TESTI20112540 | 1538 | 148 ... 1554 | 3508 |
| TESTI20112860 | 1539 | 285 ... 1829 | 3509 |
| TESTI20113150 | 1540 | 374 ... 1042 | 3510 |
| TESTI20113940 | 1541 | 1185 ... 1598 | 3511 |
| TESTI20114480 | 1542 | 161 ... 2032 | 3512 |
| TESTI20116050 | 1543 | 218 ... 1756 | 3513 |
| TESTI20116120 | 1544 | 17 ... 1276 | 3514 |
| TESTI20117500 | 1545 | 140 ... 508 | 3515 |
| TESTI20118460 | 1546 | 69 ... 1580 | 3516 |
| TESTI20120500 | 1547 | 135 ... 926 | 3517 |
| TESTI20120900 | 1548 | 60 ... 665 | 3518 |
| TESTI20121040 | 1549 | 8 ... 1525 | 3519 |
| TESTI20121710 | 1550 | 278 ... 1543 | 3520 |
| TESTI20122070 | 1551 | 145 ... 1359 | 3521 |

TABLE 1-continued

| Clone name | SEQ ID NO. of nucleotide sequence | Position of CDS | SEQ ID NO. of amino acid sequence |
|---|---|---|---|
| TESTI20122440 | 1552 | 25 ... 465 | 3522 |
| TESTI20124440 | 1553 | 469 ... 801 | 3523 |
| TESTI20125280 | 1554 | 371 ... 1363 | 3524 |
| TESTI20125440 | 1555 | 342 ... 671 | 3525 |
| TESTI20125920 | 1556 | 31 ... 1680 | 3526 |
| TESTI20126280 | 1557 | 169 ... 2562 | 3527 |
| TESTI20130530 | 1558 | 298 ... 1692 | 3528 |
| TESTI20131440 | 1559 | 223 ... 1278 | 3529 |
| TESTI20132310 | 1560 | 204 ... 713 | 3530 |
| TESTI20132680 | 1561 | 1011 ... 1448 | 3531 |
| TESTI20134010 | 1562 | 334 ... 1464 | 3532 |
| TESTI20134270 | 1563 | 59 ... 601 | 3533 |
| TESTI20134680 | 1564 | 324 ... 2726 | 3534 |
| TESTI20134970 | 1565 | 197 ... 1873 | 3535 |
| TESTI20136010 | 1566 | 152 ... > 1415 | 3536 |
| TESTI20140970 | 1567 | 376 ... 801 | 3537 |
| TESTI20142480 | 1568 | 1466 ... 1939 | 3538 |
| TESTI20142540 | 1569 | 1231 ... 1593 | 3539 |
| TESTI20143180 | 1570 | 201 ... 1946 | 3540 |
| TESTI20144390 | 1571 | 776 ... 1552 | 3541 |
| TESTI20145780 | 1572 | 1315 ... 1746 | 3542 |
| TESTI20148380 | 1573 | 32 ... 2680 | 3543 |
| TESTI20149880 | 1574 | 581 ... 982 | 3544 |
| TESTI20150420 | 1575 | 221 ... 1162 | 3545 |
| TESTI20150920 | 1576 | 142 ... 1713 | 3546 |
| TESTI20151050 | 1577 | 1290 ... 1736 | 3547 |
| TESTI20151800 | 1578 | 671 ... 1099 | 3548 |
| TESTI20152490 | 1579 | 717 ... 1226 | 3549 |
| TESTI20153310 | 1580 | 151 ... 1317 | 3550 |
| TESTI20154370 | 1581 | 192 ... 1544 | 3551 |
| TESTI20159380 | 1582 | 852 ... 1679 | 3552 |
| TESTI20161010 | 1583 | 33 ... 539 | 3553 |
| TESTI20162780 | 1584 | 607 ... 1299 | 3554 |
| TESTI20162980 | 1585 | 224 ... 1414 | 3555 |
| TESTI20164210 | 1586 | 526 ... 1593 | 3556 |
| TESTI20165680 | 1587 | 154 ... 552 | 3557 |
| TESTI20165990 | 1588 | 201 ... 992 | 3558 |
| TESTI20166290 | 1589 | 351 ... 2786 | 3559 |
| TESTI20166670 | 1590 | 754 ... 1938 | 3560 |
| TESTI20167580 | 1591 | 1152 ... > 1543 | 3561 |
| TESTI20168880 | 1592 | 201 ... 524 | 3562 |
| TESTI20169500 | 1593 | 280 ... 1674 | 3563 |
| TESTI20170170 | 1594 | 199 ... 1530 | 3564 |
| TESTI20170280 | 1595 | 1 ... 696 | 3565 |
| TESTI20170690 | 1596 | 61 ... 474 | 3566 |
| TESTI20170890 | 1597 | 882 ... 1238 | 3567 |
| TESTI20171070 | 1598 | 1088 ... 1501 | 3568 |
| TESTI20173050 | 1599 | 724 ... 1218 | 3569 |
| TESTI20173110 | 1600 | 1194 ... 1586 | 3570 |
| TESTI20173960 | 1601 | 376 ... 1764 | 3571 |
| TESTI20175370 | 1602 | 828 ... 1724 | 3572 |
| TESTI20176450 | 1603 | 1 ... 996 | 3573 |
| TESTI20179230 | 1604 | 162 ... 1709 | 3574 |
| TESTI20179510 | 1605 | 1702 ... > 2042 | 3575 |
| TESTI20180600 | 1606 | 162 ... 857 | 3576 |
| TESTI20182210 | 1607 | 736 ... 1182 | 3577 |
| TESTI20182760 | 1608 | 266 ... 1390 | 3578 |
| TESTI20183680 | 1609 | 778 ... > 1927 | 3579 |
| TESTI20184280 | 1610 | 35 ... > 1732 | 3580 |
| TESTI20184750 | 1611 | 899 ... 2116 | 3581 |
| TESTI20184760 | 1612 | 161 ... 1741 | 3582 |
| TESTI20184820 | 1613 | 189 ... 722 | 3583 |
| TESTI20186110 | 1614 | 221 ... 1606 | 3584 |
| TESTI20192570 | 1615 | 109 ... 687 | 3585 |
| TESTI20193080 | 1616 | 149 ... 2194 | 3586 |
| TESTI20193520 | 1617 | 311 ... 1375 | 3587 |
| TESTI20194880 | 1618 | 616 ... 1554 | 3588 |
| TESTI20196690 | 1619 | 271 ... 945 | 3589 |
| TESTI20196970 | 1620 | 789 ... 1565 | 3590 |
| TESTI20197030 | 1621 | 263 ... 1717 | 3591 |
| TESTI20197290 | 1622 | 643 ... 1314 | 3592 |
| TESTI20197600 | 1623 | 100 ... 909 | 3593 |
| TESTI20198540 | 1624 | 21 ... 1553 | 3594 |
| TESTI20198600 | 1625 | 909 ... 1328 | 3595 |
| TESTI20199110 | 1626 | 622 ... 1617 | 3596 |
| TESTI20199980 | 1627 | 764 ... 1102 | 3597 |
| TESTI20200120 | 1628 | 661 ... 966 | 3598 |
| TESTI20200840 | 1629 | 378 ... 818 | 3599 |
| TESTI20201760 | 1630 | 22 ... 603 | 3600 |
| TESTI20202830 | 1631 | 631 ... 972 | 3601 |
| TESTI20204260 | 1632 | 714 ... 1406 | 3602 |
| TESTI20205100 | 1633 | 270 ... 1763 | 3603 |
| TESTI20205150 | 1634 | 1286 ... 1663 | 3604 |
| TESTI20205250 | 1635 | 32 ... 1888 | 3605 |
| TESTI20207170 | 1636 | 1 ... 795 | 3606 |
| TESTI20209050 | 1637 | 269 ... 1900 | 3607 |
| TESTI20210030 | 1638 | 328 ... 675 | 3608 |
| TESTI20210570 | 1639 | 280 ... 1362 | 3609 |
| TESTI20211380 | 1640 | 372 ... 848 | 3610 |
| TESTI20212970 | 1641 | 93 ... 2102 | 3611 |
| TESTI20214630 | 1642 | 690 ... 1106 | 3612 |
| TESTI20215310 | 1643 | 294 ... 899 | 3613 |
| TESTI20219110 | 1644 | 982 ... 1344 | 3614 |
| TESTI20219390 | 1645 | 253 ... 573 | 3615 |
| TESTI20220230 | 1646 | 116 ... 967 | 3616 |
| TESTI20221790 | 1647 | 109 ... 1830 | 3617 |
| TESTI20222030 | 1648 | 277 ... 2277 | 3618 |
| TESTI20222460 | 1649 | 162 ... 1889 | 3619 |
| TESTI20223380 | 1650 | 322 ... 831 | 3620 |
| TESTI20226520 | 1651 | 178 ... 1392 | 3621 |
| TESTI20227380 | 1652 | 20 ... 1747 | 3622 |
| TESTI20228120 | 1653 | 31 ... 858 | 3623 |
| TESTI20228740 | 1654 | 607 ... 1026 | 3624 |
| TESTI20244220 | 1655 | 757 ... 2448 | 3625 |
| TESTI20244430 | 1656 | 17 ... 1444 | 3626 |
| TESTI20244460 | 1657 | 684 ... 1511 | 3627 |
| TESTI20244730 | 1658 | 127 ... 1044 | 3628 |
| TESTI20245600 | 1659 | 255 ... 1523 | 3629 |
| TESTI20245860 | 1660 | 684 ... 1058 | 3630 |
| TESTI20246410 | 1661 | 1513 ... 1818 | 3631 |
| TESTI20246480 | 1662 | 380 ... 1399 | 3632 |
| TESTI20247440 | 1663 | 425 ... 907 | 3633 |
| TESTI20248850 | 1664 | 3 ... 1829 | 3634 |
| TESTI20249360 | 1665 | 600 ... 1565 | 3635 |
| TESTI20250220 | 1666 | 63 ... 2015 | 3636 |
| TESTI20250630 | 1667 | 482 ... 1690 | 3637 |
| TESTI20251440 | 1668 | 42 ... 1271 | 3638 |
| TESTI20251610 | 1669 | 430 ... 1218 | 3639 |
| TESTI20251740 | 1670 | 730 ... 1104 | 3640 |
| TESTI20252690 | 1671 | 1182 ... 2138 | 3641 |
| TESTI20254030 | 1672 | 363 ... 1958 | 3642 |
| TESTI20254090 | 1673 | 878 ... 1360 | 3643 |
| TESTI20254480 | 1674 | 320 ... 1390 | 3644 |
| TESTI20254990 | 1675 | 693 ... 1799 | 3645 |
| TESTI20255460 | 1676 | 152 ... 2710 | 3646 |
| TESTI20256560 | 1677 | 169 ... > 2257 | 3647 |
| TESTI20257910 | 1678 | 457 ... 1311 | 3648 |
| TESTI20258720 | 1679 | 38 ... 1630 | 3649 |
| TESTI20259110 | 1680 | 486 ... 1805 | 3650 |
| TESTI20259200 | 1681 | 227 ... 1369 | 3651 |
| TESTI20260140 | 1682 | 1113 ... 1421 | 3652 |
| TESTI20260640 | 1683 | 6 ... 1109 | 3653 |
| TESTI20261040 | 1684 | 14 ... 970 | 3654 |
| TESTI20261160 | 1685 | 257 ... 868 | 3655 |
| TESTI20261680 | 1686 | 1422 ... 1901 | 3656 |
| TESTI20262150 | 1687 | 315 ... 2765 | 3657 |
| TESTI20262940 | 1688 | 255 ... 1574 | 3658 |
| TESTI20264530 | 1689 | 150 ... 1580 | 3659 |
| TESTI20264910 | 1690 | 1638 ... 2378 | 3660 |
| TESTI20265150 | 1691 | 1023 ... 1409 | 3661 |
| TESTI20265340 | 1692 | 965 ... 1552 | 3662 |
| TESTI20265890 | 1693 | 994 ... 1308 | 3663 |
| TESTI20266050 | 1694 | 116 ... 1522 | 3664 |
| TESTI20268240 | 1695 | 70 ... 1638 | 3665 |
| TESTI20269250 | 1696 | 17 ... > 1926 | 3666 |
| TESTI20269360 | 1697 | 682 ... 1005 | 3667 |
| TESTI20270130 | 1698 | 99 ... 512 | 3668 |
| TESTI20271790 | 1699 | 101 ... 1822 | 3669 |
| TESTI20272380 | 1700 | 121 ... 492 | 3670 |
| TESTI20274960 | 1701 | 619 ... 1716 | 3671 |

TABLE 1-continued

| Clone name | SEQ ID NO. of nucleotide sequence | Position of CDS | SEQ ID NO. of amino acid sequence |
|---|---|---|---|
| TESTI20277300 | 1702 | 263 . . . 1600 | 3672 |
| TESTI20278280 | 1703 | 80 . . . 607 | 3673 |
| TESTI20282420 | 1704 | 52 . . . 528 | 3674 |
| TESTI20282530 | 1705 | 699 . . . 1985 | 3675 |
| TESTI20282900 | 1706 | 30 . . . 341 | 3676 |
| TESTI20284260 | 1707 | 29 . . . 493 | 3677 |
| TESTI20285230 | 1708 | 1710 . . . 2366 | 3678 |
| TESTI20286590 | 1709 | 519 . . . 1121 | 3679 |
| TESTI20287760 | 1710 | 775 . . . 2634 | 3680 |
| THYMU10004280 | 1711 | 617 . . . 988 | 3681 |
| THYMU20006020 | 1712 | 608 . . . 1387 | 3682 |
| THYMU20007020 | 1713 | 1755 . . . 2111 | 3683 |
| THYMU20007750 | 1714 | 1077 . . . 1499 | 3684 |
| THYMU20008000 | 1715 | 1506 . . . 1955 | 3685 |
| THYMU20009460 | 1716 | 1334 . . . 1723 | 3686 |
| THYMU20009500 | 1717 | 717 . . . 2117 | 3687 |
| THYMU20009710 | 1718 | 247 . . . 762 | 3688 |
| THYMU20010180 | 1719 | 191 . . . 634 | 3689 |
| THYMU20010710 | 1720 | 850 . . . 1164 | 3690 |
| THYMU20012020 | 1721 | 1160 . . . 1561 | 3691 |
| THYMU20012560 | 1722 | 47 . . . 517 | 3692 |
| THYMU20013250 | 1723 | 131 . . . 1309 | 3693 |
| THYMU20013810 | 1724 | 196 . . . 927 | 3694 |
| THYMU20014430 | 1725 | 1280 . . . 1678 | 3695 |
| THYMU20017270 | 1726 | 16 . . . 660 | 3696 |
| THYMU20018250 | 1727 | 1205 . . . 2122 | 3697 |
| THYMU20018390 | 1728 | 237 . . . 1373 | 3698 |
| THYMU20019000 | 1729 | 405 . . . 758 | 3699 |
| THYMU20019260 | 1730 | 317 . . . 736 | 3700 |
| THYMU20020370 | 1731 | 1332 . . . 1733 | 3701 |
| THYMU20020800 | 1732 | 600 . . . 1196 | 3702 |
| THYMU20021090 | 1733 | 211 . . . 1281 | 3703 |
| THYMU20021540 | 1734 | 100 . . . 1578 | 3704 |
| THYMU20023560 | 1735 | 1429 . . . 1884 | 3705 |
| THYMU20024500 | 1736 | 199 . . . 1584 | 3706 |
| THYMU20025480 | 1737 | 1362 . . . 1751 | 3707 |
| THYMU20026950 | 1738 | 9 . . . 920 | 3708 |
| THYMU20028150 | 1739 | 233 . . . 1222 | 3709 |
| THYMU20028410 | 1740 | 10 . . . 1086 | 3710 |
| THYMU20029830 | 1741 | 46 . . . 456 | 3711 |
| THYMU20030460 | 1742 | 453 . . . 1175 | 3712 |
| THYMU20030690 | 1743 | 1658 . . . 2269 | 3713 |
| THYMU20031330 | 1744 | 90 . . . 569 | 3714 |
| THYMU20032820 | 1745 | 250 . . . 1176 | 3715 |
| THYMU20034400 | 1746 | 791 . . . 1123 | 3716 |
| THYMU20034790 | 1747 | 120 . . . 452 | 3717 |
| THYMU20036500 | 1748 | 56 . . . 1657 | 3718 |
| THYMU20039320 | 1749 | 584 . . . 1339 | 3719 |
| THYMU20043440 | 1750 | 1301 . . . 1615 | 3720 |
| THYMU20043560 | 1751 | 292 . . . 621 | 3721 |
| THYMU20044100 | 1752 | 1800 . . . 2228 | 3722 |
| THYMU20044520 | 1753 | 1387 . . . 1899 | 3723 |
| THYMU20046350 | 1754 | 1863 . . . 2351 | 3724 |
| THYMU20046770 | 1755 | 321 . . . 671 | 3725 |
| THYMU20049060 | 1756 | 172 . . . 732 | 3726 |
| THYMU20050010 | 1757 | 206 . . . 1681 | 3727 |
| THYMU20051340 | 1758 | 886 . . . 1209 | 3728 |
| THYMU20052460 | 1759 | 1300 . . . 1683 | 3729 |
| THYMU20052830 | 1760 | 92 . . . 1504 | 3730 |
| THYMU20054800 | 1761 | 479 . . . 880 | 3731 |
| THYMU20055450 | 1762 | 112 . . . 426 | 3732 |
| THYMU20055460 | 1763 | 20 . . . 361 | 3733 |
| THYMU20055740 | 1764 | 901 . . . 1341 | 3734 |
| THYMU20055760 | 1765 | 232 . . . 738 | 3735 |
| THYMU20058550 | 1766 | 1170 . . . 1493 | 3736 |
| THYMU20060480 | 1767 | 2046 . . . > 2453 | 3737 |
| THYMU20062520 | 1768 | 299 . . . 655 | 3738 |
| THYMU20062610 | 1769 | 136 . . . 1953 | 3739 |
| THYMU20062770 | 1770 | 381 . . . 1199 | 3740 |
| THYMU20063650 | 1771 | 264 . . . 800 | 3741 |
| THYMU20064680 | 1772 | 253 . . . 621 | 3742 |
| THYMU20066660 | 1773 | 405 . . . 1487 | 3743 |
| THYMU20069130 | 1774 | 341 . . . 961 | 3744 |
| THYMU20069460 | 1775 | 231 . . . 575 | 3745 |
| THYMU20069650 | 1776 | 728 . . . 1036 | 3746 |
| THYMU20070250 | 1777 | 81 . . . 1703 | 3747 |
| THYMU20071120 | 1778 | 170 . . . 1792 | 3748 |
| THYMU20071460 | 1779 | 152 . . . 499 | 3749 |
| THYMU20072580 | 1780 | 1981 . . . 2286 | 3750 |
| THYMU20073070 | 1781 | 551 . . . 1225 | 3751 |
| THYMU20073080 | 1782 | 755 . . . 1198 | 3752 |
| THYMU20077250 | 1783 | 645 . . . 1241 | 3753 |
| THYMU20078020 | 1784 | 1290 . . . 1598 | 3754 |
| THYMU20078240 | 1785 | 1506 . . . 1838 | 3755 |
| THYMU20079690 | 1786 | 1049 . . . 1714 | 3756 |
| THYMU20080490 | 1787 | 57 . . . 398 | 3757 |
| THYMU20081110 | 1788 | 629 . . . 1246 | 3758 |
| THYMU20083390 | 1789 | 592 . . . 924 | 3759 |
| THYMU20083500 | 1790 | 744 . . . 1067 | 3760 |
| THYMU20083830 | 1791 | 155 . . . 1786 | 3761 |
| THYMU20084520 | 1792 | 286 . . . 597 | 3762 |
| THYMU20086430 | 1793 | 769 . . . 1077 | 3763 |
| THYMU20087270 | 1794 | 842 . . . 2008 | 3764 |
| THYMU20089170 | 1795 | 305 . . . 619 | 3765 |
| THYMU20089900 | 1796 | 1008 . . . 1421 | 3766 |
| THYMU20090230 | 1797 | 106 . . . 594 | 3767 |
| THYMU20091040 | 1798 | 728 . . . 1054 | 3768 |
| THYMU20095920 | 1799 | 1809 . . . 2378 | 3769 |
| THYMU20096580 | 1800 | 120 . . . 692 | 3770 |
| THYMU20097920 | 1801 | 95 . . . 2086 | 3771 |
| THYMU20098350 | 1802 | 99 . . . 1802 | 3772 |
| THYMU20099060 | 1803 | 80 . . . 1573 | 3773 |
| THYMU20100940 | 1804 | 8 . . . 2218 | 3774 |
| THYMU20104480 | 1805 | 39 . . . 1451 | 3775 |
| THYMU20106990 | 1806 | 673 . . . 1464 | 3776 |
| THYMU20110720 | 1807 | 372 . . . 1070 | 3777 |
| THYMU20112570 | 1808 | 117 . . . 455 | 3778 |
| THYMU20112590 | 1809 | 112 . . . 1827 | 3779 |
| THYMU20115380 | 1810 | 1507 . . . 1839 | 3780 |
| THYMU20115730 | 1811 | 943 . . . 1632 | 3781 |
| THYMU20117850 | 1812 | 1625 . . . 1948 | 3782 |
| THYMU20120240 | 1813 | 1239 . . . 3002 | 3783 |
| THYMU20120730 | 1814 | 1257 . . . 2459 | 3784 |
| THYMU20121040 | 1815 | 230 . . . 2323 | 3785 |
| THYMU20128910 | 1816 | 181 . . . 1185 | 3786 |
| THYMU20129020 | 1817 | 1545 . . . > 2019 | 3787 |
| THYMU20130470 | 1818 | 87 . . . 1169 | 3788 |
| THYMU20134260 | 1819 | 1845 . . . 2171 | 3789 |
| THYMU20137050 | 1820 | 958 . . . 1341 | 3790 |
| THYMU20137570 | 1821 | 2113 . . . 2571 | 3791 |
| THYMU20139160 | 1822 | 69 . . . 686 | 3792 |
| THYMU20140510 | 1823 | 1312 . . . 1626 | 3793 |
| THYMU20143230 | 1824 | 575 . . . 2023 | 3794 |
| THYMU20145990 | 1825 | 1330 . . . 2262 | 3795 |
| THYMU20148010 | 1826 | 326 . . . 820 | 3796 |
| THYMU20149230 | 1827 | 581 . . . 925 | 3797 |
| THYMU20150190 | 1828 | 1516 . . . 1908 | 3798 |
| THYMU20151610 | 1829 | 218 . . . 1663 | 3799 |
| THYMU20153210 | 1830 | 1135 . . . 2340 | 3800 |
| THYMU20154790 | 1831 | 1220 . . . 1753 | 3801 |
| THYMU20157620 | 1832 | 771 . . . 1487 | 3802 |
| THYMU20163600 | 1833 | 1216 . . . 1650 | 3803 |
| THYMU20170080 | 1834 | 944 . . . 1399 | 3804 |
| THYMU20170230 | 1835 | 835 . . . 1941 | 3805 |
| THYMU20171580 | 1836 | 821 . . . 1150 | 3806 |
| THYMU20174490 | 1837 | 52 . . . 453 | 3807 |
| THYMU20174790 | 1838 | 29 . . . 370 | 3808 |
| THYMU20175260 | 1839 | 991 . . . 1452 | 3809 |
| THYMU20176010 | 1840 | 12 . . . 2039 | 3810 |
| THYMU20177070 | 1841 | 1059 . . . 1415 | 3811 |
| THYMU20178440 | 1842 | 81 . . . 1517 | 3812 |
| THYMU20181890 | 1843 | 102 . . . 1652 | 3813 |
| THYMU20184550 | 1844 | 171 . . . 1886 | 3814 |
| THYMU20185470 | 1845 | 161 . . . 817 | 3815 |
| THYMU20185650 | 1846 | 36 . . . 536 | 3816 |
| THYMU20187210 | 1847 | 190 . . . 507 | 3817 |
| THYMU20191970 | 1848 | 230 . . . 1597 | 3818 |
| TKIDN10000620 | 1849 | 1075 . . . 1419 | 3819 |
| TKIDN10001710 | 1850 | 1685 . . . 2365 | 3820 |
| TKIDN10001920 | 1851 | 98 . . . 793 | 3821 |

TABLE 1-continued

| Clone name | SEQ ID NO. of nucleotide sequence | Position of CDS | SEQ ID NO. of amino acid sequence |
|---|---|---|---|
| TRACH20011010 | 1852 | 228 ... 2033 | 3822 |
| TRACH20011540 | 1853 | 125 ... 478 | 3823 |
| TRACH20012490 | 1854 | 83 ... 1600 | 3824 |
| TRACH20021000 | 1855 | 234 ... 854 | 3825 |
| TRACH20021380 | 1856 | 313 ... 1890 | 3826 |
| TRACH20025370 | 1857 | 947 ... 1456 | 3827 |
| TRACH20026640 | 1858 | 964 ... 1557 | 3828 |
| TRACH20029880 | 1859 | 201 ... 1607 | 3829 |
| TRACH20040390 | 1860 | 125 ... 3319 | 3830 |
| TRACH20041090 | 1861 | 1254 ... 1589 | 3831 |
| TRACH20043360 | 1862 | 30 ... 2066 | 3832 |
| TRACH20044990 | 1863 | 209 ... 790 | 3833 |
| TRACH20049500 | 1864 | 840 ... 1166 | 3834 |
| TRACH20051590 | 1865 | 927 ... 1247 | 3835 |
| TRACH20057200 | 1866 | 2082 ... 2393 | 3836 |
| TRACH20058000 | 1867 | 187 ... 1647 | 3837 |
| TRACH20073990 | 1868 | 98 ... 454 | 3838 |
| TRACH20080810 | 1869 | 2073 ... > 2910 | 3839 |
| TRACH20081270 | 1870 | 1681 ... > 2025 | 3840 |
| TRACH20090060 | 1871 | 309 ... 1781 | 3841 |
| TRACH20091070 | 1872 | 129 ... 1841 | 3842 |
| TRACH20093400 | 1873 | 131 ... 2251 | 3843 |
| TRACH20093480 | 1874 | 694 ... 1092 | 3844 |
| TRACH20098510 | 1875 | 142 ... 1944 | 3845 |
| TRACH20101590 | 1876 | 1660 ... 2220 | 3846 |
| TRACH20104510 | 1877 | 144 ... 1184 | 3847 |
| TRACH20108240 | 1878 | 36 ... 791 | 3848 |
| TRACH20113020 | 1879 | 177 ... 1352 | 3849 |
| TRACH20122980 | 1880 | 732 ... 1562 | 3850 |
| TRACH20123870 | 1881 | 235 ... 540 | 3851 |
| TRACH20124970 | 1882 | 109 ... 486 | 3852 |
| TRACH20125620 | 1883 | 22 ... 387 | 3853 |
| TRACH20129180 | 1884 | 1545 ... 1898 | 3854 |
| TRACH20131230 | 1885 | 123 ... 2939 | 3855 |
| TRACH20139280 | 1886 | 152 ... 1474 | 3856 |
| TRACH20140180 | 1887 | 203 ... 553 | 3857 |
| TRACH20143710 | 1888 | 1219 ... 1998 | 3858 |
| TRACH20149500 | 1889 | 163 ... 906 | 3859 |
| TRACH20149720 | 1890 | 187 ... 1695 | 3860 |
| TRACH20149740 | 1891 | 864 ... 1505 | 3861 |
| TRACH20158240 | 1892 | 254 ... 796 | 3862 |
| TRACH20159390 | 1893 | 1618 ... 1941 | 3863 |
| TRACH20160800 | 1894 | 1223 ... 1531 | 3864 |
| TRACH20163470 | 1895 | 971 ... 2356 | 3865 |
| TRACH20164100 | 1896 | 372 ... 722 | 3866 |
| TRACH20164810 | 1897 | 1685 ... 2104 | 3867 |
| TRACH20165330 | 1898 | 704 ... 1102 | 3868 |
| TRACH20165540 | 1899 | 810 ... 1514 | 3869 |
| TRACH20167090 | 1900 | 57 ... 1148 | 3870 |
| TRACH20170860 | 1901 | 186 ... 1625 | 3871 |
| TRACH20173680 | 1902 | 83 ... 1597 | 3872 |
| TRACH20174980 | 1903 | 93 ... 1088 | 3873 |
| TRACH20182780 | 1904 | 1669 ... 2070 | 3874 |
| TRACH20185210 | 1905 | 13 ... 339 | 3875 |
| TRACH20188350 | 1906 | 248 ... 1015 | 3876 |
| TRACH20190460 | 1907 | 351 ... 1526 | 3877 |
| UMVEN10001380 | 1908 | 2122 ... 2436 | 3878 |
| UTERU10001060 | 1909 | 187 ... 552 | 3879 |
| UTERU10001870 | 1910 | 1681 ... 2031 | 3880 |
| UTERU20000230 | 1911 | 120 ... 608 | 3881 |
| UTERU20000950 | 1912 | 240 ... 1658 | 3882 |
| UTERU20011760 | 1913 | 1719 ... 2090 | 3883 |
| UTERU20013890 | 1914 | 1544 ... 1951 | 3884 |
| UTERU20016580 | 1915 | 25 ... 1287 | 3885 |
| UTERU20026620 | 1916 | 1020 ... 1556 | 3886 |
| UTERU20027360 | 1917 | 1624 ... 1992 | 3887 |
| UTERU20029930 | 1918 | 82 ... 1902 | 3888 |
| UTERU20031350 | 1919 | 35 ... 520 | 3889 |
| UTERU20035770 | 1920 | 920 ... 1282 | 3890 |
| UTERU20040150 | 1921 | 917 ... 1717 | 3891 |
| UTERU20040370 | 1922 | 22 ... 1866 | 3892 |
| UTERU20040390 | 1923 | 727 ... 1200 | 3893 |
| UTERU20040730 | 1924 | 1009 ... > 2303 | 3894 |
| UTERU20041630 | 1925 | 105 ... 1328 | 3895 |
| UTERU20041970 | 1926 | 26 ... 484 | 3896 |
| UTERU20045200 | 1927 | 6 ... 917 | 3897 |
| UTERU20051790 | 1928 | 415 ... 1341 | 3898 |
| UTERU20064120 | 1929 | 147 ... 1061 | 3899 |
| UTERU20065470 | 1930 | 389 ... 694 | 3900 |
| UTERU20079240 | 1931 | 408 ... 713 | 3901 |
| UTERU20083020 | 1932 | 23 ... 826 | 3902 |
| UTERU20086530 | 1933 | 1274 ... 1783 | 3903 |
| UTERU20087070 | 1934 | 1274 ... 2467 | 3904 |
| UTERU20087850 | 1935 | 464 ... 991 | 3905 |
| UTERU20089300 | 1936 | 906 ... 1253 | 3906 |
| UTERU20089390 | 1937 | 11 ... 1729 | 3907 |
| UTERU20089620 | 1938 | 132 ... 725 | 3908 |
| UTERU20090940 | 1939 | 122 ... 631 | 3909 |
| UTERU20091470 | 1940 | 260 ... 697 | 3910 |
| UTERU20094830 | 1941 | 127 ... 1578 | 3911 |
| UTERU20095100 | 1942 | 1593 ... 1913 | 3912 |
| UTERU20099040 | 1943 | 59 ... 883 | 3913 |
| UTERU20099510 | 1944 | 705 ... 2375 | 3914 |
| UTERU20101150 | 1945 | 874 ... 1188 | 3915 |
| UTERU20102260 | 1946 | 270 ... 671 | 3916 |
| UTERU20103040 | 1947 | 1164 ... 1772 | 3917 |
| UTERU20103200 | 1948 | 374 ... 709 | 3918 |
| UTERU20104310 | 1949 | 90 ... 425 | 3919 |
| UTERU20106510 | 1950 | 1649 ... 2275 | 3920 |
| UTERU20121140 | 1951 | 880 ... 1644 | 3921 |
| UTERU20122520 | 1952 | 572 ... > 2146 | 3922 |
| UTERU20125810 | 1953 | 21 ... 329 | 3923 |
| UTERU20127030 | 1954 | 618 ... 1763 | 3924 |
| UTERU20127150 | 1955 | 707 ... 1699 | 3925 |
| UTERU20128560 | 1956 | 203 ... 721 | 3926 |
| UTERU20132620 | 1957 | 330 ... 1007 | 3927 |
| UTERU20134830 | 1958 | 121 ... 1341 | 3928 |
| UTERU20139760 | 1959 | 982 ... 1659 | 3929 |
| UTERU20140010 | 1960 | 42 ... 368 | 3930 |
| UTERU20167570 | 1961 | 57 ... 710 | 3931 |
| UTERU20168960 | 1962 | 317 ... 1468 | 3932 |
| UTERU20169020 | 1963 | 30 ... 782 | 3933 |
| UTERU20173030 | 1964 | 1985 ... > 2355 | 3934 |
| UTERU20176230 | 1965 | 1004 ... 1372 | 3935 |
| UTERU20177150 | 1966 | 3 ... 350 | 3936 |
| UTERU20181270 | 1967 | 153 ... 620 | 3937 |
| UTERU20185220 | 1968 | 521 ... 1357 | 3938 |
| UTERU20188670 | 1969 | 231 ... 1886 | 3939 |
| UTERU20188840 | 1970 | 1834 ... 2181 | 3940 |

Namely, primers used to synthesize polynucleotides can be designed based on the nucleotide sequences of polynucleotides of the present invention shown in SEQ ID NOs in the above Table 1. When one intends to synthesize full-length cDNAs, an oligo dT primer can be used as the 3'-end primer. The length of the primers is usually 15–100 bp, and favorably between 15–35 bp. In case of LA PCR, which is described below, the primer length of 25–35 bp may provide a good result.

A method to design a primer that enables a specific amplification based on the aimed nucleotide sequence is known to those skilled in the art (Current Protocols in Molecular Biology, Ausubel et al. edit, (1987) John Wiley & Sons, Section 6.1–6.4). In designing a primer based on the 5'-end sequence, the primer is designed so as that, in principle, the amplification products will include the translation start site. Accordingly, for example, when the 5'-end primer is designed based on the nucleotide sequence of 5' untranslated region (5'UTR), any part of the 5'-end, which ensures the specificity to the cDNA of interest, can be selected as the primer.

When synthesizing a full-length cDNA, the target nucleotide sequence to be amplified can extend to several thousand bp in some cDNA. However, it is possible to amplify such a long nucleotides by using such as LA PCR (Long and Accurate PCR). It is advantageous to use LA PCR when synthesizing long DNA. In LA PCR, in which a special DNA polymerase having 3'->5' exonuclease activity is used, mis-incorporated nucleotides can be removed. Accordingly, accurate synthesis of the complementary strand can be achieved even with a long nucleotide sequence. By using LA PCR, it is reported that amplification of a nucleotide with 20 kb longer can be achieved under desirable conditions (Takeshi Hayashi (1996) Jikken-Igaku Bessatsu, "Advanced Technologies in PCR" Youdo-sha).

A template DNA for synthesizing the full-length cDNA of the present invention can be obtained by using cDNA libraries that are prepared by various methods. The full-length cDNA clones of the present invention are clones with high probability of completeness in length, which were obtained by the method comprising the steps of [1] preparing libraries containing cDNAs with the very high fullness ratio by oligo-capping, and [2] assembling the 5'-end sequences and selecting one with the highest probability of completeness in length in the cluster formed (there are many clones longer in the 5'-end direction).

However, the uses of primers designed based on the full-length nucleotide sequences provided by the present invention enable easily obtaining full-length cDNAs without such a special technique.

The problem with the cDNA libraries prepared by the known methods or commercially available is that mRNA contained in the libraries has very low fullness ratio. Thus, it is difficult to screen full-length cDNA clone directly from the library using ordinary cloning methods. The present invention has revealed a nucleotide sequence of novel full-length cDNA. If a full-length nucleotide sequence is provided, it is possible to synthesize a target full-length cDNA by using enzymatic reactions such as PCR. In particular, a full-length-enriched cDNA library, synthesized by methods such as oligo-capping, is desirable to synthesize a full-length cDNA with more reliability.

The 5'-end sequence of the full-length cDNA clones of the invention can be used to isolate the regulatory element of transcription including the promoter on the genome. A rough draft of the human genome (analysis of human genomic sequence with lower accuracy), which covers 90% of the genome, has been reported (Nature, Vol.409, 814–823, 2001), and by the year 2003, analysis of the entire human genomic sequence is going to be finished. However, it is hard to analyze with software the transcription start sites on the human genome, in which long introns exist. By contrast, it is easy to specify the transcription start site on the genomic sequence using the nucleotide sequence which includes the 5'-end of the full-length cDNA clone of the present invention, and thus it is easy to obtain the genomic region involved in transcription regulation, which includes the promoter that is contained in the upstream of the transcription start site.

The polypeptide encoded by the full-length cDNA of the invention can be prepared as a recombinant polypeptide or as a natural polypeptide. For example, the recombinant polypeptide can be prepared by inserting the polynucleotide encoding the polypeptide of the invention into a vector, introducing the vector into an appropriate host cell and purifying the polypeptide expressed within the transformed host cell, as described below. In contrast, the natural polypeptide can be prepared, for example, by utilizing an affinity column to which an antibody against the polypeptide of the invention (Current Protocols in Molecular Biology (1987) Ausubel et al. edit, John Wiley & Sons, Section 16.1–16.19) is attached. The antibody used for affinity purification may be either a polyclonal antibody, or a monoclonal antibody. Alternatively, in vitro translation (See, for example, "On the fidelity of mRNA translation in the nuclease-treated rabbit reticulocyte lysate system." Dasso M. C., and Jackson R. J. (1989) Nucleic Acids Res. 17: 3129–3144) may be used for preparing the polypeptide of the invention.

Polypeptides functionally equivalent to the polypeptides of the present invention can be prepared based on the activities, which were clarified in the above-mentioned manner, of the polypeptides of the present invention. Using the biological activity possessed by the polypeptide of the invention as an index, it is possible to verify whether or not a particular polypeptide is functionally equivalent to the polypeptide of the invention by examining whether or not the polypeptide has said activity.

Polypeptides functionally equivalent to the polypeptides of the present invention can be prepared by those skilled in the art, for example, by using a method for introducing mutations into an amino acid sequence of a polypeptide (for example, site-directed mutagenesis (Current Protocols in Molecular Biology, edit, Ausubel et al., (1987) John Wiley & Sons, Section 8.1–8.5). Besides, such polypeptides can be generated by spontaneous mutations. The present invention also includes a polypeptide comprising the amino acid sequence shown in Table 1 in which one or more amino acids are substituted, deleted, inserted, and/or added, as long as the polypeptides have the equivalent functions to those of the polypeptides identified in the present Examples described later.

There are no limitations on the number and sites of amino acid mutations, as long as the polypeptides maintain the functions thereof. The number of mutations typically corresponds to 30% or less, or 20% or less, or 10% or less, preferably 5% or less, or 3% or less of the total amino acids, more preferably 2% or less or 1% or less of the total amino acids. Alternatively, herein, substitution of one or more amino acids includes substitution of several amino acids. As used herein, the term "several amino acids" means, for example, 5 amino acids, preferably 4 or 3 amino acids, more preferably 2 amino acids, and further preferably 1 amino acid.

From the viewpoint of maintaining the polypeptide function, it is preferable that a substituted amino acid has a similar property to that of the original amino acid. For example, Ala, Val, Leu, Ile, Pro, Met, Phe. and Trp are assumed to have similar properties to one another because they are all classified into a group of non-polar amino acids. Similarly, substitution can be performed among non-charged amino acid such as Gly, Ser, Thr, Cys, Tyr, Asn, and Gln, acidic amino acids such as Asp and Glu, and basic amino acids such as Lys, Arg, and His.

In addition, polypeptides functionally equivalent to the polypeptides of the present invention can be isolated by using techniques of hybridization or gene amplification known to those skilled in the art. Specifically, using the hybridization technique (Current Protocols in Molecular Biology, edit, Ausubel et al., (1987) John Wiley & Sons, Section 6.3–6.4) ), those skilled in the art can usually isolate a polynucleotide highly homologous to the polynucleotide encoding the polypeptide identified in the present Example based on the identified nucleotide sequence (Table 1) or a portion thereof and obtain the functionally equivalent polypeptide from the isolated polynucleotide. The present invention include polypeptides encoded by the polynucleotides hybridizing with the polynucleotides encoding the polypeptides identified in the present Example, as long as the polypeptides are functionally equivalent to the polypeptides identified in the present Example. Organisms from which the functionally equivalent polypeptides are isolated are illustrated by vertebrates such as human, mouse, rat, rabbit, pig and bovine, but are not limited to these animals.

Washing conditions of hybridization for the isolation of polynucleotides encoding the functionally equivalent polypeptides are usually "1×SSC, 0.1% SDS, 37° C."; more stringent conditions are "0.5×SSC, 0.1% SDS, 42° C."; and still more stringent conditions are "0.1×SSC, 0.1% SDS, 65° C.". Alternatively, the following conditions can be given as hybridization conditions of the present invention. Namely, conditions in which the hybridization is done at "6×SSC, 40% Formamide, 25° C.", and the washing at "1×SSC, 55° C." can be given. More preferable conditions are those in which the hybridization is done at "6×SSC, 40% Formamide, 37° C.", and the washing at "0.2×SSC, 55° C.". Even more preferable are those in which the hybridization is done at "6×SSC, 50% Formamide, 37° C.", and the washing at "0.1×SSC, 62° C.". The more stringent the conditions of hybridization are, the more frequently the polynucleotides highly homologous to the probe sequence are isolated. Therefore, it is preferable to conduct hybridization under stringent conditions. Examples of stringent conditions in the present invention are, washing conditions of "0.5×SSC, 0.1% SDS, 42° C.", or alternatively, hybridization conditions of "6×SSC, 40% Formamide, 37° C.", and the washing at "0.2×SSC, 55° C.".

One skilled in the art can suitably select various conditions, such as dilution ratios of SSC, formamide concentrations, and temperatures to accomplish a similar stringency.

However, the above-mentioned combinations of SSC, SDS and temperature conditions are indicated just as examples. Those skilled in the art can select the hybridization conditions with similar stringency to those mentioned above by properly combining the above-mentioned or other factors (for example, probe concentration, probe length and duration of hybridization reaction) that determines the stringency of hybridization.

The amino acid sequences of polypeptides isolated by using the hybridization techniques usually have high identity to those of the polypeptides of the present invention, which are shown in Table 1. The present invention encompasses a polynucleotide comprising a nucleotide sequence that has a high identity to the nucleotide sequence of claim 1 (a). Furthermore, the present invention encompasses a peptide, or polypeptide comprising an amino acid sequence that has a high identity to the amino acid sequence encoded by the polynucleotide of claim 1 (b). The term "high identity" indicates sequence identity of at least 40% or more; preferably 60% or more; and more preferably 70% or more. Alternatively, more preferable is identity of 90% or more, or 93% or more, or 95% or more, furthermore, 97% or more, or 99% or more. The identity can be determined by using the BLAST search algorithm.

As used herein, "percent identity" of amino acid sequences or nucleic acids is determined using the algorithm BLAST of Karlin and Altschul (Proc. Natl. Acad. Sci. USA 90:5873–5877, 1993). Such an algorithm is incorporated into the BLASTN and BLASTX programs of Altschul et al. (J. Mol. Biol.215:403–410, 1990). BLAST nucleotide searches are performed with the BLASTN program, for example, score=100, wordlength=12. BLAST protein searches are performed with the BLASTX program, for example, score=50, wordlength=3. When utilizing BLAST and Gapped BLAST programs, the default parameters of the respective programs are used.

With the gene amplification technique (PCR) (Current Protocols in Molecular Biology, edit, Ausubel et al., (1987) John Wiley & Sons, Section 6.1–6.4)) using primers designed based on the nucleotide sequence (Table 1) or a portion thereof identified in the present Example, it is possible to isolate a polynucleotide fragment highly homologous to the polynucleotide sequence or a portion thereof and to obtain functionally equivalent polypeptide to a particular polypeptide identified in the present Example based on the isolated polynucleotide fragment.

The present invention also provides a polynucleotide containing at least 15 nucleotides complementary to a polynucleotide comprising a nucleotide sequence of SEQ ID NOs shown in Table 1 or the complementary strand thereof. Herein, the term "complementary strand" is defined as one strand of a double strand DNA composed of A:T and G:C base pair to the other strand. Also, "complementary" is defined as not only those completely matching within a continuous region of at least 15 nucleotides, but also having a identity of at least 70%, favorably 80% or higher, more favorably 90% or higher, and most favorably 95% or higher within that region. The identity may be determined using the algorithm described herein.

Such a polynucleotide includes probes and primers used for the detection and amplification of a polynucleotide encoding the inventive polypeptide. When used as a primer, the polynucleotide usually comprises 15 to 100 bp, and preferably of 15 to 35 bp. When used as a probe, the polynucleotide comprises the whole or a part of the sequence of a polynucleotide of the invention, and comprises at least 15 bp. When used as primers, such polynucleotides are complementary at the 3'-end, and restriction enzyme recognition sequences or tags can be added to the 5'-end.

Furthermore, polynucleotides of the present invention include an antisense polynucleotide for suppressing the expression of a polypeptide of the invention, which comprises an amino acid sequence of SEQ ID NOs shown in Table 1. To exert an antisense effect, an antisense polynucleotide has at least 15 bp or more, for example 50 bp or more, preferably 100 bp or more, and more preferably 500 bp or more, and usually has 3000 bp or less, and preferably 2000 bp or less. Antisense polynucleotides can be used in the gene therapy of diseases caused by abnormalities of the polypeptides of the invention (abnormal function or abnormal expression). An antisense polynucleotide can be prepared, for example, by the phosphorothioate method ("Physicochemical properties of phosphorothioate oligodeoxynucleotides." Stein (1988) Nucleic Acids Res. 16: 3209–3221) based on the sequence information of polynucleotide encoding a polypeptide of the invention (for example, the nucleotide sequences of SEQ ID NO: 1 to 1970).

The polynucleotides or antisense polynucleotides of the present invention can be used in, for example, gene therapy. As target diseases, for example, cancers or various inflammatory diseases may be preferable. These molecules can be used for gene therapy, for example, by administrating them to patients by the in vivo or ex vivo method using virus vectors such as retrovirus vectors, adenovirus vectors, and adeno-related virus vectors, or non-virus vectors such as liposomes.

The present invention also includes a partial peptide of the polypeptides of the invention. The partial peptide comprises a polypeptide generated as a result that a signal peptide has been removed from a secretory protein. If the polypeptide of the present invention has an activity as a receptor or a ligand, the partial peptide may function as a competitive inhibitor of the polypeptide and may bind to the receptor (or ligand). In addition, the present invention includes an antigen peptide for raising antibodies. For the peptides to be specific for the polypeptide of the invention, the peptides comprise at least 7 amino acids, preferably 8 amino acids or more, more preferably 9 amino acids or more, and even more preferably 10 amino acids or more. The peptide can be used for preparing antibodies against the polypeptide of the invention, or competitive inhibitors of them, and also screening for a receptor that binds to the polypeptide of the invention. The partial peptides of the invention can be produced, for example, by genetic engineering methods, known methods for synthesizing peptides, or digesting the polypeptide of the invention with an appropriate peptidase.

The present invention also relates to a vector into which a polynucleotide of the invention is inserted. The vector of the invention is not limited as long as it contains the inserted polynucleotide stably. For example, if E. coil is used as a host, vectors such as pBluescript vector (Stratagene) are preferable as a cloning vector. To produce the polypeptide of the invention, expression vectors are especially useful. Any expression vector can be used as long as it is capable of expressing the polypeptide in vitro, in E. coli, in cultured cells, or in vivo. For example, pBEST vector (Promega) is preferable for in vitro expression, pET vector (Invitrogen) for E. coli, pME18S-FL3 vector (GenBank Accession No. AB009864) for cultured cells, and pME18S vector (Mol. Cell. Biol. (1988) 8: 466–472) for in vivo expression. To insert the polynucleotide of the invention, ligation utilizing restriction sites can be performed according to the standard method (Current Protocols in Molecular Biology (1987) Ausubel et al. edit, John Wiley & Sons, Section 11.4–11.11).

Recently, the technique of GATEWAY™ system (Invitrogen), which is an expression vector construction system for polypeptide expression, has been developed (Experimental Medicine, Vol. 18, No. 19 (December), p2716–2717, 2000). This system includes two types of site-specific recombinases (BP CLONASE™ and LR CLONASE™) derived from lambda phage and uses BP CLONASE™-specific recombination sites for an Entry Vector and LR CLONASE™-specific recombination sites for a Destination Vector, which may comprise a tag useful for polypeptide purification. With this system, an expression vector can be obtained by using homologous recombination.

First, a polynucleotide fragment of interest is inserted into the entry vector using the first recombination. Then, the secondary recombination is allowed to take place between the entry vector, where the polynucleotide fragment of interest has been inserted, and the destination vector. Thus, the expression vector can be prepared rapidly and highly efficiently. With the above-mentioned typical method using restriction enzyme and ligase reactions, the step of expression vector construction and expression of polypeptide of interest takes about 7 to 10 days. However, with the GATEWAY™ system, the polypeptide of interest can be expressed and prepared in only 3 to 4 days. Thus, the system ensures a high-throughput functional analysis for expressed polypeptides.

The present invention also relates to a transformant carrying the vector of the invention. Any cell can be used as a host into which the vector of the invention is inserted, and various kinds of host cells can be used depending on the purposes. For strong expression of the polypeptide in eukaryotic cells, COS cells or CHO cells can be used, for example.

Introduction of the vector into host cells can be performed, for example, by calcium phosphate precipitation method, electroporation method (Current Protocols in Molecular Biology (1987) Ausubel et al. edit, John Wiley & Sons, Section 9.1–9.9), lipofectamine method (GIBCO-BRL), or microinjection method, etc.

Further, a polynucleotide containing at least 15 nucleotides comprising a nucleotide sequence of any one of the polynucleotides comprising the nucleotide sequences of SEQ ID NOs shown in Table 1 or the complementary strand thereof can be used not only as a primer for synthesizing full-length cDNAs but also for testing and diagnosing the abnormalities of the polypeptide encoded by the full-length cDNA of the present invention. For example, by utilizing polymerase chain reaction (genomic DNA-PCR, or RT-PCR) using the polynucleotide of the invention as a primer, polynucleotide encoding the polypeptide of the invention can be amplified. It is also possible to obtain the regulatory region of expression in the 5'-upstream by using PCR or hybridization since the transcription start site within the genomic sequence can be easily specified based on the 5'-end sequence of the full-length cDNA. The obtained genomic region can be used for detection and/or diagnosis of the abnormality of the sequence by RFLP analysis, SSCP, or sequencing. Especially, in the case where expression of the mRNA of the present invention varies according to a specific disease, analysis of the amount of expression of the mRNA using the polynucleotide of the present invention as a probe or a primer enables detection and diagnosis of the disease.

The present invention also relates to antibodies that bind to the polypeptide of the invention. There are no limitations in the form of the antibodies of the invention. They include polyclonal antibodies, monoclonal antibodies, or their portions that can bind to an antigen. They also include antibodies of all classes. Furthermore, special antibodies such as humanized antibodies and chimeric antibodies are also included.

The polyclonal antibody of the invention can be obtained according to the standard method by synthesizing an oligopeptide corresponding to the amino acid sequence and immunizing rabbits with the peptide (Current Protocols in Molecular Biology (1987) Ausubel et al. edit, John Wiley & Sons, Section 11.12–11.13). The monoclonal antibody of the invention can be obtained according to the standard method by purifying the polypeptide expressed in E. coli, immunizing mice with the polypeptide, and producing a hybridoma cell by fusing the spleen cells and myeloma cells (Current Protocols in Molecular Biology (1987) Ausubel et al. edit, John Wiley & Sons, Section 11.4–11.11).

The antibody binding to the polypeptide of the present invention can be used for purification of the polypeptide of the invention, and also for detection and/or diagnosis of the abnormalities of the expression and structure of the polypeptide. Specifically, polypeptides can be extracted, for example, from tissues, blood, or cells, and the polypeptide of the invention is detected by Western blotting, immunoprecipitation, or ELISA, etc. for the above purpose.

Furthermore, the antibody binding to the polypeptide of the present invention can be utilized for treating the diseases that associates with the polypeptide of the invention. If the antibodies are used for treating patients, human antibodies, humanized antibodies, or chimeric antibodies are preferable in terms of their low antigenicity. The human antibodies can be prepared by immunizing a mouse whose immune system is replaced with that of human (e.g., see "Functional transplant of megabase human immunoglobulin loci recapitulates human antibody response in mice" Mendez, M. J. et al.

(1997) Nat. Genet. 15: 146–156). The humanized antibodies can be prepared by recombination of the hypervariable region of a monoclonal antibody (Methods in Enzymology (1991) 203: 99–121).

A cDNA of the present invention encodes, for example, an amino acid sequence of a protein that is predicted to have the following function. The use of the amino acid sequences of the polypeptides encoded by the cDNAs of the present invention enables predicting that the polypeptides have the following functions. It can be predict, from the results of homology search of SwissProt, GenBank, UniGene, or nr, that these polypeptides have such functions. Specifically, for instance, as shown in Examples, searching for a known gene or polypeptide that is homologous to the partial sequence of the full-length cDNA of the invention (1970 clone) and referring the function of the gene and of the polypeptide encoded by the gene make it possible to predict the function of the polypeptide encoded by the cDNA of the invention. In this way, each of 1078 clones out of the 1970 full-length cDNA clones of the invention was predicted to encode a polypeptide that was classified into the following categories.

Secretory and/or membrane protein (516 clones)
Glycoprotein-related protein (121 clones)
Signal transduction-related protein (88 clones)
Transcription-related protein (143 clones)
Disease-related protein (331 clones)
Enzyme and/or metabolism-related protein (219 clones)
Cell division- and/or cell proliferation-related protein (44 clones)
Cytoskeleton-related protein (80 clones)
Nuclear protein and/or RNA synthesis-related protein (70 clones)
Protein synthesis- and/or transport-related protein (20 clones)
Cellular defense-related protein (10 clones)
Development and/or differentiation-related protein (19 clones)
DNA- and/or RNA-binding protein (168 clones)
ATP- and/or GTP-binding protein (93 clones)

The functions of the polypeptides encoded by the cDNAs of the present invention can be predicted by assessing the presence of signal sequence, transmembrane region, nuclear translocation signal, glycosylation signal, phosphorylation site, and zinc finger motif, SH3 domain, etc. in the amino acid sequences. The programs, PSORT (Nakai K., and Kanehisa M. (1992) Genomics 14: 897–911), SOSUI (Hirokawa T. et al. (1998) Bioinformatics 14: 378–379) (Mitsui Knowledge Industry), and MEMSAT (Jones D. T., Taylor W. R., and Thornton J. M. (1994) Biochemistry 33: 3038–3049) can be used to predict the existence of the signal sequence or transmembrane region. Alternatively, a partial amino acid sequence of the polypeptide is fused with another polypeptide such as GFP, the fusion polypeptide is transfected into cultured cells, and the localization is analyzed to predict the function of the original polypeptide.

Based on the determined nucleotide sequences of the full-length cDNAs obtained in the present invention, it is possible to predict more detailed functions of the polypeptides encoded by the cDNA clones, for example, by searching the databases such as GenBank, Swiss-Prot, UniGene, and nr for homologies of the cDNAs; or by searching the, amino acid sequences deduced from the full-length cDNAs for signal sequences by using software programs such as PSORT, for transmembrane regions by using software programs such as SOSUI or for motifs by using software programs such as Pfam and PROSITE. As a matter of course, the functions are often predictable by using partial sequence information (preferably 300 nucleotides or more) instead of the full-length nucleotide sequences. However, the result of the prediction by using partial nucleotide sequence does not always agree with the result obtained by using full-length nucleotide sequence, and thus, it is needless to say that the prediction of function is preferably performed based on the full-length nucleotide sequences.

GenBank, Swiss-Prot, UniGene and nr databases were searched for homologies of the full-length nucleotide sequences of the 1970 clones (see Example 6). The amino acid sequences deduced from the full-length nucleotide sequences were searched for functional domains by PSORT, SOSUI and Pfam. Prediction of functions of polypeptides encoded by the clones and the categorization thereof were performed based on these results obtained. The categorization was carried out by the following method.

[1] Firstly, the cDNA clones were classified into the above-mentioned 14 functional categories based on the results of annotation-based categorization (using the keywords in the case of Swiss-Prot hit data; using Definition or Reference information in the case of GenBank, UniGene, or nr hit data), and the signal sequence search of the deduced ORFs by PSORT and the transmembrane region search by SOSUI.

[2] Secondly, clones which had been unassignable to the categories by the method of [1] were searched for functional domains and/or motifs by Pfam. Based on the results, the clones were additionally classified into the above-mentioned 14 types of categories when they had a functional domain and/or motif assignable to any one of the categories.

The following 516 clones presumably belong to secretory and/or membrane proteins.

ADRGL20020290, ADRGL20021910,
ADRGL20036380, ADRCL20036840,
ADRGL20059610, ADRGL20063770,
ADRGL20066770, ASTRO20010010,
ASTRO20020240, ASTRO20045840,
ASTRO20053430, ASTRO20055530,
ASTRO20055570, ASTRO20055930,
ASTRO20088950, ASTRO20091180,
BNGH420021680, BNGH420023870,
BNGH420046790, BNGH420052350,
BNGH420059680, BNGH420075940,
BNGH420077980, BRACE10000510,
BRACE20051930, BRACE20052530,
BRACE20054080, BRACE20066360,
BRACE20068710, BRACE20069000,
BRACE20069110, BRACE20194670,
BRACE20204670, BRACE20216950,
BRAMY10001730, BRAMY20003880,
BRAMY20013670, BRAMY20024790,
BRAMY20027390, BRAMY20028530,
BRAMY20035380, BRAMY20044920,
BRAMY20045210, BRAMY20047560,
BRAMY20050940, BRAMY20053910,
BRAMY20055760, BRAMY20072440,
BRAMY20083820, BRAMY20089770,
BRAMY20091230, BRAMY20094890,
BRAMY20096930, BRAMY20118410,
BRAMY20123400, BRAMY20125550,
BRAMY20127310, BRAMY20127760,
BRAMY20135720, BRAMY20137360,
BRAMY20139440, BRAMY20152510,
BRAMY20194680, BRAMY20204270,
BRAMY20225320, BRAMY20237190,
BRAMY20245140, BRAMY20251750,
BRAMY20285650, BRAWH20020470,
BRAWH20021910, BRAWH20026010,
BRAWH20030000, BRAWH20039640,
BRAWH20055330, BRAWH20078620,
BRAWH20093070, BRAWH20185270,

-continued

BRCAN10000760, BRCAN10001680, BRCAN20001480, BRCAN20004180, BRCAN20005230, BRCOC20000470, BRCOC20003600, BRHIP10000720, BRHIP10001040, BRHIP20000210, BRSSN20001970, BRSSN20074640, BRSSN20091190, CD34C20001750, CTONG20017490, CTONG20036990, CTONG20041260, CTONG20044870, CTONG20045500, CTONG20049480, CTONG20051450, CTONG20055850, CTONG20056150, CTONG20059130, CTONG20060040, CTONG20063770, CTONG20065680, CTONG20068360, CTONG20069320, CTONG20071680, CTONG20076810, CTONG20078340, CTONG20079590, CTONG20083980, CTONG20084020, CTONG20085210, CTONG20167750, CTONG20168240, CTONG20179890, CTONG20183830, CTONG20184830, DFNES20018000, DFNES20029660, DFNES20057660, DFNES20072990, DFNES20080880, FCBBF20018680, FCBBF20029280, FCBBF20032930, FCBBF20036360, FCBBF20054390, FCBBF30004340, FCBBF30022680, FCBBF30029250, FCBBF30042610, FCBBF30062490, FCBBF30075970, FCBBF30078600, FCBBF30091520, FCBBF30095410, FCBBF30105440, FCBBF30118670, FCBBF30132660, FCBBF30135890, FCBBF30145670, FCBBF30164510, FCBBF30169870, FCBBF30171230, FCBBF30172330, FCBBF30177290, FCBBF30179740, FCBBF30195690, FCBBF30197840, FCBBF30212210, FCBBF30223110, FCBBF30223210, FCBBF30225930, FCBBF30230610, FCBBF30260480, FCB3F30266510, FCBBF30287940, FCBBF50000610, FCBBF50004950, FEBRA20007820, FEBRA20018670, FEBRA20031280, FEBRA20031810, FEBRA20038220, FEBRA20039260, FEBRA20040230, FEBRA20040560, FEBRA20046280, FEBRA20080860, FEBRA20084750, FEBRA20088810, FEBRA20115930, FEBRA20116650, FEBRA20121950, FEBRA20141980, FEBRA20177800, FEBRA20182030, FEBRA20191720, HCHON10001660, HCHON20015050, HEART10001490, HEART20031680, HHDPC10001140, HHDPC20051850, HHDPC20082790, HHDPC20088160, HLUNG20015070, HLUNG20015180, HLUNG20020850, HLUNG20029490, HLUNG20032460, HLUNG20033350, HLUNG20034970, HLUNG20037160, HLUNG20041540, HLUNG20042730, HLUNG20050760, HLUNG20052300, HLUNG20060670, HLUNG20065990, HLUNG20074330, HLUNG20081390, HLUNG20088750, HLUNG20092530, KIDNE20016360, KIDNE20083150, KIDNE20084030, KIDNE20084040, KIDNE20084800, KIDNE20086490, KIDNE20086660, KIDNE20094670, KIDNE20134130, KIDNE20142900, KIDNE20143200, KIDNE20148080, KIDNE20160960, KIDNE20163710, KIDNE20169180, KIDNE20182540, KIDNE20186170, KIDNE20188630, KIDNE20189960, LIVER20007750, LIVER20010510, LIVER20010990, LIVER20026440, LIVER20030650, LIVER20038000, MESAN20007110, MESAN20008150, MESAN20021220, MESAN20027900, MESAN20058110,

-continued

MESAN20059570, MESAN20060430, MESAN20067430, MESAN20084150, MESAN20095220, NT2NE20018740, NT2NE20021860, NT2NE20039210, NT2NE20053230, NT2NE20059210, NT2NE20064780, NT2NE20069580, NT2NE20080770, NT2NE20082130, NT2NE20092950, NT2NE20140130, NT2NE20145250, NT2NE20146510, NT2NE20152620, NT2NE20167660, NT2NE20181800, NT2RI20016240, NT2RI20021200, NT2RI20033920, NT2RP70003110, NT2RP70027790, NT2RP70031070, NT2RP70031480, NT2RP70056690, NT2R270087140, NTONG20034540, NTONG20053630, OCBBF20000740, OCBBF20012520, OCBBF20109780, OCBBF20110210, OCBBF20110730, OCBBF20112280, OCBBF20118720, OCBBF20120010, OCBBF20123200, OCBBF20155030, OCBBF20165900, OCBBF20165910, OCBBF20170350, OCBBF20176650, OCBBF20185630, OCBBF20191950, PANCR10000860, PEBLM20001800, PLACE50001290, PLACE60004260, PLACE60006300, PLACE60053280, PLACE60055590, PLACE60056910, PLACE60057860, PLACE60061370, PLACE60064740, PLACE60070500, PLACE60087680, PLACE60104630, PLACE60107010, PLACE60113340, PLACE60138840, PLACE60154450, PLACE60184870, PROST10001100, PROST20011160, PROST20014150, PROST20035830, PROST20045700, PROST20050390, PROST20065100, PROST20073280, PROST20082430, PROST20084680, PROST20084720, PROST20099090, PROST20105450, PROST20106060, PROST20108850, PROST20110120, PROST20114100, PROST20146590, PROST20152510, PROST20168600, PUAEN10000870, SKMUS20006790, SKMUS20020770, SKMUS20073150, SKMUS20091900, SKNMC20006350, SKNSH20094350, SMINT2000G090, SMINT20008110, SMINT20024140, SMINT20028840, SMINT20045470, SMINT20077960, SMINT20081330, SMINT20086250, SMINT20088440, SMINT20088690, SMINT20092160, SPLEN20015100, SPLEN20017610, SPLEN20017810, SPLEN20024190, SPLEN20024620, SPLEN20054500, SPLEN20058180, SPLEN20063890, SPLEN20073880, SPLEN20080070, SPLEN20090880, SPLEN20101950, SPLEN20104690, SPLEN20105100, SPLEN20108000, SPLEN20110180, SPLEN20110860, SPLEN20118050, SPLEN20121790, SPLEN20125230, SPLEN20136700, SPLEN20138600, SPLEN20139100, SPLEN20175920, SPLEN20177400, SPLEN20182850, SPLEN20183020, SPLEN20183950, SPLEN20190080, SPLEN20190770, SPLEN20193230, SPLEN20193490, SPLEN20193790, SPLEN20201830, SPLEN20204670, TESOP10000350, TESTI10000190, TESTI20006160, TESTI20029100, TESTI20031310, TESTI20032770, TESTI20038240, TESTI20043130, TESTI20043220, TESTI20045390, TESTI20046540, TESTI20046870, TESTI20047370, TESTI20050400, TESTI20051200, TESTI20051730, TESTI20053260, TESTI20053780,

-continued

TESTI20057200, TESTI20057590,
TESTI20059080, TESTI20061200,
TESTI20062120, TESTI20063330,
TESTI20063410, TESTI20063600,
TESTI20066330, TESTI20068530,
TESTI20070400, TESTI20070740,
TESTI20073460, TESTI20086840,
TESTI20095200, TESTI20095440,
TESTI20095880, TESTI20100090,
TESTI20102390, TESTI20105910,
TESTI20113940, TESTI20116120,
TESTI20121040, TESTI20121710,
TESTI20131440, TEST120142540,
TESTI20149880, TESTI20151800,
TESTI20162780, TESTI20170170,
TESTI20173050, TESTI20182760,
TESTI20183680, TESTI20184750,
TESTI20186110, TESTI20198540,
TESTI20199110, TESTI20202830,
TESTI20204260, TESTI20210030,
TESTI20214630, TESTI20219110,
TESTI20244730, TESTI20245600,
TESTI20245860, TESTI20246410,
TESTI20251610, TESTI20257910,
TESTI20260640, TESTI20261040,
TESTI20262150, TESTI20262940,
TESTI20264910, TESTI20271790,
TESTI20278280, TESTI20282420,
TESTI20282900, TESTI20286590,
THYMU20007020, THYMU20012020,
THYMU20017270, THYMU20020800,
THYMU20025480, THYMU20028150,
THYMU20030690, THYMU20034790,
THYMU20046350, THYMU20046770,
THYMU20050010, THYMU20052830,
THYMU20054800, THYMU20055740,
THYMU20055760, THYMU20062770,
THYMU20078240, THYMU20079690,
THYMU20083390, THYMU20087270,
THYMU20100940, THYMU20115380,
THYMU20137050, THYMU20137570,
THYMU20143230, THYMU20150190,
THYMU20153210, THYMU20154790,
THYMU20163600, THYMU20171580,
THYMU20178440, THYMU20185470,
TRACH20011010, TRACH20011540,
TRACH20021380, TRACH20073990,
TRACH20081270, TRACH20090060,
TRACH20149720, TRACH20149740,
TRACH20159390, TRACH20163470,
TRACH20165330, TRACH20167090,
TRACH20173680, TRACH20190460,
UMVEN10001380, UTERU20035770,
UTERU20040150, UTERU20045200,
UTERU20064120, UTERU20086530,
UTERU20087070, UTERU20087850,
UTERU20089300, UTERU20089620,
UTERU20095100, UTERU20099040,
UTERU20103200, UTERU20125810,
UTERU20127030, UTERU20127150,
UTERU20139760, UTERU20188840

The following 121 clones presumably belong to glycoprotein-related proteins.

ADRGL20020290, ADRGL20036840,
ADRGL20059610, ADRGL20066770,
ASTRO20055570, BNGH420046790,
BNGH420077980, BRACE20051930,
BRACE20069000, BRACE20204670,
BRACE20216950, BRAMY20013670,
BRAMY20089770, BRAMY20251210,
BRAWH20039640, BRCAN10000760,
BRCAN20005230, BRCOC20003600,

-continued

CD34C20001750, CTONG20017490,
CTONG20036990, CTONG20045500,
CTONG20059130, CTONG20079590,
CTONG20085210, CTONG20184830,
DFNES20018000, DFNES20080880,
FCBBF30004340, FCBBF30029250,
FCBBF30062490, FCBBF30091520,
FCBBF30164510, FCBBF30171230,
FCBBF30195690, FCBBF30223210,
FEBRA20038220, HCHON20015050,
HLUNG20015070, HLUNG20032460,
HLUNG20037160, HLUNG20041540,
KIDNE20142900, KIDNE20169180,
KIDNE20186170, KIDNE20189960,
MESAN20021220, MESAN20058110,
NT2NE20064780, NT2NE20140130,
NT2NE20155650, NT2RP70056690,
NTONG20053630, OCBBF20000740,
OCBBF20012520, OCBBF20110210,
OCBBF20120010, OCBBF20165900,
OCBBF20165910, OCBBF20191950,
PEBLM20001800, PLACE60004260,
PLACE60087680, PLACE60113340,
PLACE60184870, PROST20033240,
PROST20099090, PROST20108850,
PROST20146590, SKMUS20073150,
SKNMC20006350, SMINT20028840,
SMINT20056230, SMINT20083290,
SMINT20091190, SPLEN20024620,
SPLEN20063890, SPLEN20080070,
SPLEN20090880, SPLEN20118050,
SPLEN20139100, SPLEN20183020,
SPLEN20201830, TESTI10000190,
TESTI20031310, TESTI20043990,
TESTI20045390, TESTI20051200,
TESTI20057590, TESTI20059080,
TESTI20066330, TESTI20086840,
TESTI20100090, TESTI20105910,
TESTI20154370, TESTI20164210,
TESTI20182760, TESTI20184750,
TESTI20199110, TESTI20219110,
TESTI20220230, TESTI20245600,
TESTI20251610, TESTI20257910,
TESTI20286590, THYMU20024500,
THYMU20028150, THYMU20052830,
THYMU20062770, THYMU20099060,
THYMU20170080, THYMU20178440,
TRACH20011010, TRACH20011540,
TRACH20021380, TRACH20149740,
TRACH20170860, TRACH20190460,
UTERU20086530, UTERU20087070,
UTERU20127030

The following 88 clones presumably belong to signal transduction-related proteins.

ASTRO20050810, ASTRO20052420,
ASTRO20085080, ASTRO20090680,
BNGH420008150, BNGH420015760,
BNGH420035290, BNGH420086030,
BRAMY20035830, BRAMY20043630,
BRAMY20118490, BRAMY20206340,
BRAMY20244490, BRAMY20251210,
BRAMY20263000, BRAWH20093040,
BRAWH20190550, CTONG20004520,
CTONG20029030, CTONG20030280,
CTONG20063930, CTONG20070720,
CTONG20189000, FCBBF30001100,
FCBBF30076310, FCBBF30100080,
FCBBF30143550, FCBBF30153170,
FCBBF30175350, FCBBF30250980,
FEBRA20090160, FEBRA20173330,
HCHON20000870, HLUNG20011260,
HLUNG20084790, KIDNE20089870,

-continued

KIDNE20160360, LIVER20011640,
MESAN20021130, MESAN20027240,
MESAN20065990, NT2NE20018890,
NT2NE20042550, NT2RP70075800,
NTONG20043080, NTONG20048440,
PLACE60071800, PROST20033240,
PROST20052850, PROST20065790,
PROST20075280, SKNSH20052400,
SKNSH20057920, SMINT20006020,
SMINT20035050, SPLEN20023540,
SPLEN20039180, SPLEN20048800,
SPLEN20049840, SPLEN20054160,
SPLEN20085910, SPLEN20191020,
SPLEN20198390, TESTI20046490,
TESTI20049060, TESTI20053070,
TESTI20066650, TESTI20081890,
TESTI20095770, TESTI20106820,
TESTI20112860, TESTI20145780,
TESTI20150420, TESTI20168880,
TESTI20205250, TESTI20228120,
TESTI20244220, TESTI20244460,
TESTI20251740, TESTI20261160,
TESTI20264530, THYMU20013250,
THYMU20039320, THYMU20106990,
THYMU20145990, THYMU20170080,
THYMU20176010, TRACH20188350

The following 143 clones presumably belong to transcription-related proteins.

ASTRO20038400, ASTRO20075150,
BNGH420070370, BNGH420074600,
BNGH420087430, BRACE20003310,
BRACE20061620, BRAMY20001510,
BRAMY20040580, BRAMY20076100,
BRAMY20111780, BRAWH20040680,
BRAWH20050740, BRAWH20080580,
BRAWH20082920, BRAWH20095900,
BRSSN20066440, CTONG20020950,
CTONG20044230, CTONG20053990,
CTONG20072930, CTONG20074000,
CTONG20084660, CTONG20186370,
CTONG20186520, DFNES20028170,
DFNE320046840, DFNES20073320,
FCBBF30003610, FCBBF30019140,
FCBBF30021900, FCBBF30093170,
FCBBF30114850, FCBBF30129010,
FCBBF30136230, FCBBF30143550,
FCBBF30220050, FCBBF30228940,
FCBBF30263080, FCBBF30285930,
FCBBF50003530, FEBRA20026820,
FEBRA20027070, FEBRA20046510,
FEBRA20057010, FEBRA20063720,
FEBRA20170240, HCHON10000150,
HCHON20002650, HEART20019310,
HLUNG20014590, HLUNG20028110,
HLUNG20063700, KIDNE20140870,
LIVER20006260, MESAN20016270,
MESAN20038520, NT2NE20038870,
NT2NE20053950, NT2NE20060750,
NT2NE20061030, NT2NE20079670,
NT2NE20082600, NT2RP70001120,
NT2RP70029780, NT2RP70046410,
NT2RP70057500, NT2RP70075300,
NT2RP70090870, OCBBF20116250,
OCBBF20120950, OCBBF20121910,
OCBBF20156450, OCBBF20157970,
OCBBF20166900, OCBBF20175360,
OCBBF20177540, PEBLM20003260,
PLACE60052940, PLACE60066970,
PLACE60122970, PLACE60150510,
PLACE60177880, PROST20007170,
PROST20024250, PROST20035170,
PROST20127450, PROST20151370,
PROST20155370, PUAEN10000650,
PUAEN20003120, SMINT20011950,
SMINT20026200, SMINT20030740,
SMINT20039050, SMINT20044140,
SMINT20086720, SPLEN20042200,
SPLEN20043680, SPLEN20055600,
SPLEN20059270, SPLEN20063250,
SPLEN20098030, SPLEN20197930,
TESTI10001570, TESTI20057430,
TESTI20057840, TESTI20059810,
TESTI20067480, TESTI20068790,
TESTI20075240, TESTI20079220,
TESTI20088840, TESTI20104090,
TESTI20122070, TESTI20166670,
TESTI20171070, TESTI20173960,
TESTI20184760, TESTI20194880,
TESTI20197600, TESTI20228740,
TESTI20254030, TESTI20254990,
TESTI20266050, TESTI20274960,
TESTI20282530, THYMU10004280,
THYMU20019260, THYMU20032820,
THYMU20071120, THYMU20077250,
TKIDN10001920, UTERU20016580,
UTERU20026620, UTERU20041630,
UTERU20094830, UTERU20099510,
UTERU20101150, UTERU20169020,
UTERU20177150, UTERU20185220,
UTERU20188670

The following 331 clones presumably belong to disease-related proteins.

ADRGL20020290, ADRGL20021910,
ADRGL20026790, ADRGL20036840,
ADRGL20059610, ADRGL20066770,
ASTRO20038400, ASTRO20052420,
ASTRO20055570, ASTRO20075150,
ASTRO20088950, BNGH420008150,
BNGH420086030, BRACE10000510,
BRACE20003310, BRACE20069000,
BRACE20097540, BRACE20194670,
BRACE20196180, BRACE20204670,
BRACE20216950, BRAMY20003540,
BRAMY20005080, BRAMY20035830,
BRAMY20040580, BRAMY20043630,
BRAMY20044920, BRAMY20051820,
BRAMY20056620, BRAMY20089770,
BRAMY20111780, BRAMY20152510,
BRAMY20190550, BRAMY20221600,
BRAMY20227860, BRAMY20274510,
BRAWH20082920, BRAWH20093040,
BRAWH20095900, BRAWH20190530,
BRAWH20191980, BRCAN10000760,
BRCAN10001050, BRCAN20005230,
BRSSN20066440, CTONG20004520,
CTONG20029030, CTONG20042640,
CTONG20045500, CTONG20052780,
CTONG20053990, CTONG20070780,
CTONG20070910, CTONG20072930,
CTONG20083980, CTONG20084660,
CTONG20165750, CTONG20169040,
CTONG20183430, CTONG20183830,
CTONG20186290, CTONG20189000,
DFNES20016470, DFNES20025500,
DFNES20046840, DFNES20055400,
DFNES20080880, FCBBF10000230,
FCBBF20035490, FCBBF20066340,
FCBBF30002270, FCBBF30002280,
FCBBF30019140, FCBBF30053300,
FCBBF30071500, FCBBF30072440,
FCBBF30076310, FCBBF30080730,
FCBBF30100080, FCBBF30115920,
FCBBF30118670, FCBBF30129010,
FCBBF30132050, FCBBF30136230,
FCBBF30153170, FCBBF30164510,

FCBBF30166220, FCBBF30171230, FCBBF30175350, FCBBF30194550, FCBBF30220050, FCBBF30223210, FCBBF30259050, FCBBF30263080, FCBBF30275590, FCBBF50001650, FEBRA20027070, FEBRA20045380, FEBRA20046200, FEBRA20046510, FEBRA20057010, FEBRA20063720, FEBRA20078800, FEBRA20087550, FEBRA20088810, FEBRA20090160, FEBRA20092760, FEBRA20151750, FEBRA20170240, FEBRA20173330, FEBRA20191720, HCHON10000150, HCHON20015050, HEART20009590, HEART20022200, HEART20063100, HHDPC20081230, HLUNG20008460, HLUNG20014590, HLUNG20032460, HLUNG20063700, HLUNG20065990, HLUNG20069350, HLUNG20081530, HLUNG20082350, HLUNG20083330, HLUNG20085210, KIDNE20081170, KIDNE20084040, KIDNE20088240, KIDNE20089870, KIDNE20133460, KIDNE20134890, KIDNE20141700, KIDNE20142900, KIDNE20150730, KIDNE20152440, KIDNE20160360, KIDNE20165390, KIDNE20169180, KIDNE20173430, KIDNE20189960, LIVER20026440, MESAN2000E200, MESAN20021130, MESAN20033220, MESAN20056890, MESAN20057240, MESAN20065990, MESAN20067430, MESAN20069530, NESOP20004520, NT2NE20018890, NT2NE20026200, NT2NE20037050, NT2NE20053950, NT2NE20061030, NT2NE20111190, NT2NE20117580, NT2NE20119980, NT2NE20140130, NT2NE20141040, NT2RI20093010, NT2RP70003110, NT2RP70046410, NT2R270075300, NTONG20032100, NTONG20034540, OCBBF20000740, OCBBF20012520, OCBBF20111600, OCBBF20120010, OCBBF20156450, OCBBF20157970, OCBBF20191950, PEBLM20001800, PEBLM20003260, PLACE60004260, PLACE60012620, PLACE60054230, PLACE60054870, PLACE60062660, PLACE60087680, PLACE60184870, PROST20015210, PROST20024250, PROST20036350, PROST20050390, PROST20058860, PROST20063430, PROST20065790, PROST20084720, PROST20099090, PROST20120070, PROST20127450, PROST20146590, PROST20152510, PROST20168600, PUAEN10000650, PUAEN20003120, SKMUS20008730, SKMUS20017400, SKMUS20040440, SKMUS20073590, SKMUS20079150, SKNSH20009710, SMINT20002320, SMINT20007470, SMINT20008110, SMINT20011950, SMINT20016150, SMINT20026200, SMINT20030740, SMINT20049920, SMINT20077960, SMINT20083290, SMINT20086250, SMINT20089600, SMINT20091190, SPLEN20023540, SPLEN20024190, SPLEN20042200, SPLEN20043680, SPLEN20055600, SPLEN20057830, SPLEN20059270, SPLEN20063890, SPLEN20073500, SPLEN20080070, SPLEN20085910, SPLEN20090880, SPLEN20098030, SPLEN20118050, SPLEN20136730, SPLEN20138600, SPLEN20139100, SPLEN20139360, SPLEN20180980, SPLEN20187490, SPLEN20193790, SPLEN20201830, TESTI10000190, TESTI20031310, TESTI20035790, TESTI20041630, TESTI20049060, TESTI20050720, TESTI20051200, TESTI20057430, TESTI20057590, TESTI20059080, TESTI20062120, TESTI20067480, TESTI20071630, TESTI20099350, TESTI20105130, TESTI20105910, TESTI20108060, TESTI20125920, TESTI20130530, TESTI20131440, TESTI20134680, TESTI20142540, TESTI20143180, TESTI20150420, TESTI20154370, TESTI20164210, TESTI20166670, TESTI20168880, TESTI20171070, TESTI20182760, TESTI20184750, TESTI20193080, TESTI20194880, TESTI20196970, TESTI20197600, TESTI20201760, TESTI20207170, TESTI20219110, TESTI20228740, TESTI20244430, TESTI20246480, TESTI20251740, TESTI20252690, TESTI20254030, TESTI20257910, TESTI20258720, TESTI20266050, TESTI20271790, TESTI20274960, TESTI20282530, TESTI20286590, THYMU10004280, THYMU20006020, THYMU20013250, THYMU20019260, THYMU20023560, THYMU20028150, THYMU20032820, THYMU20034400, THYMU20055460, THYMU20063650, THYMU20070250, THYMU20071120, THYMU20081110, THYMU20090230, THYMU20095920, THYMU20098350, THYMU20099060, THYMU20120730, THYMU20121040, THYMU20170080, THYMU20185650, THYMU20191970, TKIDN10000620, TKIDN10001920, TRACH20011540, TRACH20091070, TRACH20143710, TRACH20170860, UTERU10001060, UTERU20026620, UTERU20041630, UTERU20086530, UTERU20087070, UTERU20087850, UTERU20099510, UTERU20101150, UTERU20104310, UTERU20127030, UTERU20185220

The following 219 clones presumably belong to the category of enzymes and/or metabolism-related proteins.

ADRGL20059610, ASTRO20026320, ASTRO20050810, ASTRO20088950, BNGH420008150, BNGH420035290, BNGH420074600, BRACE20050870, BRACE20097540, BRACE20200770, BRACE20204670, BRACE20215410, BRAMY20003540, BRAMY20005080, BRAMY20027990, BRAMY20028620, BRAMY20044920, BRAMY20055760, BRAMY20056620, BRAMY20072870, BRAMY20093490, BRAMY20096930, BRAMY20118490, BRAMY20125360, BRAMY20143870, BRAMY20152510, BRAMY20231150, BRAMY20244490, BRAMY20251210, BRAWH20021910, BRAWH20082920, BRAWH20093040, BRAWH20094900, BRAWH20183170, BRAWH20188750, BRAWH20190550, BRAWH20191980, BRCAN20005230, BRCOC20003600, CTONG20051100, CTONG20070910, CTONG20076810, CTONG20079590, CTONG20080140, CTONG20085210, CTONG20186290, DFNES20063460, DFNES20080880, FCBBF20023490, FCBBF20066340, FCBBF30004340, FCBBF30019140,

FCBBF30022680, FCBBF30029250,
FCBBF30072440, FCBBF30076310,
FCBBF30085560, FCBBF30091520,
FCBBF30107290, FCBBF30125880,
FCBBF30132050, FCBBF30143550,
FCBBF30153170, FCBBF30166220,
FCBBF30171230, FCBBF30175350,
FCBBF30236670, FCBBF30260480,
FEBRA20038220, FEBRA20040560,
FEBRA20078800, FEBRA20090160,
FEBRA20172230, FEBRA20173330,
HCHON20000870, HCHON20002710,
HEART10001490, HEART20022200,
HEART20047640, HEART20082570,
HLUNG20011260, HLUNG20032460,
HLUNG20041540, HLUNG20042730,
HLUNG20054790, KIDNE20080690,
KIDNE20083620, KIDNE20084040,
KIDNE20147170, KIDNE20152440,
KIDNE20173150, KIDNE20186170,
KIDNE20189960, LIVER20011640,
LIVER20026440, LIVER20055270,
MESAN20021130, MESAN20033220,
MESAN20038520, MESAN20057240,
MESAN20058110, MESAN20065990,
MESAN20095800, NT2NE20026200,
NT2NE20042550, NT2NE20117580,
NT2NE20127900, NT2RI20093010,
NT2RP70064570, NTONG20034540,
NTONG20043080, NTONG20053630,
NTONG20053730, NTONG20058010,
OCBBF20120010, OCBBF20167290,
OCBBF20191950, PANCR10000860,
PLACE60052940, PLACE60064180,
PLACE60073090, PLACE60095600,
PLACE60184410, PLACE60188630,
PROST20007600, PROST20033240,
PROST20036350, PROST20039300,
PROST20050390, PROST20051310,
PROST20052850, PROST20065790,
PROST20075280, PROST20084720,
PROST20099090, PROST20108850,
PROST20152510, PUAEN20001520,
PUAEN20002470, SKNMC20006350,
SKNSH20057920, SMINT20008110,
SMINT20049920, SMINT20094680,
SPLEN20023540, SPLEN20024930,
SPLEN20043680, SPLEN20048800,
SPLEN20054500, SPLEN20057900,
SPLEN20071820, SPLEN20080070,
SPLEN20085910, SPLEN20108000,
SPLEN20136730, SPLEN20180980,
TESTI20012080, TESTI20030200,
TESTI20031310, TESTI20038240,
TESTI20050720, TESTI20051200,
TESTI20059080, TESTI20062120,
TESTI20066330, TESTI20076570,
TESTI20103690, TESTI20105130,
TESTI20106820, TESTI20108060,
TESTI20112860, TESTI20121040,
TESTI20130530, TESTI20131440,
TESTI20168880, TESTI20170170,
TESTI20196690, TESTI20196970,
TESTI20199110, TESTI20205250,
TESTI20212970, TESTI20222030,
TESTI20226520, TESTI20227380,
TESTI20244460, TESTI20244730,
TESTI20250630, TESTI20260640,
TESTI20262940, TESTI20264530,
TESTI20285230, THYMU20006020,
THYMU20013250, THYMU20034400,
THYMU20039320, THYMU20055460,
THYMU20055760, THYMU20063650,
THYMU20066660, THYMU20070250,
THYMU20087270, THYMU20096580,
THYMU20100940, THYMU20110720,
THYMU20120240, THYMU20120730,
THYMU20170230, TRACH20011010,
TRACH20021380, TRACH20091070,
TRACH20113020, TRACH20143710,
TRACH20164100, TRACH20190460,
UTERU20087070, UTERU20089620,
UTERU20104310, UTERU20185220,
UTERU20288670

The following 44 clones presumably belong to the category of cell division- and/or cell proliferation-related proteins.

ASTRO20090680, BRACE20079370,
BRAMY20234820, BRCAN10001050,
BRCAN20005410, CTONG20032930,
FCBBF20070950, FCBBF30002270,
FCBBF30053300, FCBBF30105860,
FCBBF30175350, FCBBF30215240,
FCBBF30275590, FEBRA20045380,
HLUNG20068120, KIDNE20134890,
KIDNE20150730, MESAN20021470,
NT2NE20077250, NT2NE20153620,
NT2RP70030840, NTONG20053910,
OCBBF20111370, OCBBF20174580,
PROST20063430, SKNMC10001230,
SMINT20028800, SPLEN20023540,
SPLEN20057830, SPLEN20139360,
TESTI20031410, TESTI20057840,
TESTI20065650, TESTI20066650,
TESTI20107320, TESTI20108060,
TESTI20114480, TESTI20134680,
TESTI20143180, TESTI20150920,
TESTI20201760, TESTI20278280,
TESTI20284260, THYMU20097920

The following 80 clones presumably belong to the category of cytoskeleton-related proteins.

ADRGL20062330, ASTRO20053430,
BGGI120000670, BRACE20079370,
BRAMY20038980, BRAMY20083330,
BRAMY20094890, CTONG20004110,
CTONG20032930, CTONG20077760,
CTONG20083980, CTONG20169040,
CTONG20183430, DFNES20018000,
FCBBF30105860, FCBBF30130410,
FCBBF30194550, FCBBF30201630,
FCBBF30271990, FEBRA20005040,
FEBRA20046200, FEBRA20099860,
HCHON20015050, HLUNG20081530,
KIDNE20081170, NT2RP70001730,
NT2RP70003110, NTONG20032100,
OCBBF20166890, OCBBF20174890,
PLACE60054870, PLACE60055590,
PLACE60071800, PLACE60118810,
PROST20015210, PROST20097840,
PROST20120070, PROST20146590,
SKMUS20007260, SKMUS20008730,
SKMUS20017400, SKMUS20073590,
SMINT20062050, SMINT20074330,
SMINT20077960, SPLEN20039180,
SPLEN20049840, SPLEN20076470,
SPLEN20182990, SPLEN20187490,
SPLEN20195710, TESTI10000190,
TESTI20041630, TESTI20057880,
TESTI20058920, TESTI20060080,
TESTI20064530, TESTI20064650,
TESTI20065650, TESTI20067440,
TESTI20071130, TESTI20099350,
TESTI20112540, TESTI20125280,

-continued

TESTI20136010, TESTI20153310,
TESTI20175370, TESTI20222460,
TESTI20244430, TESTI20254030,
TESTI20258720, THYMU20024500,
THYMU20062610, THYMU20098350,
TRACH20043360, TRACH20098510,
TRACH20149500, UTERU20089390,
UTERU20122520, UTERU20168960

The following 70 clones presumably belong to the category of nuclear proteins and/or RNA synthesis-related proteins.

ASTRO20026320, BRACE20050870,
BRACE20200770, BRAMY20134050,
BRAWH20063010, BRAWH20093040,
BRAWH20174330, BRAWH20176850,
CTONG20042640, FCBBF20023490,
FCBBF20035490, FCBBF20070950,
FCBBF30002270, FCBBF30048420,
FCBBF30080730, FCBBF30115920,
FCBBF30236670, FEBRA20035240,
FEBRA20092760, FEBRA20173330,
HHDPC20081230, HLUNG20011460,
HLUNG20068120, KIDNE20089870,
KIDNE20150730, MESAN20056890,
MESAN20057240, NT2NE20037050,
NT2NE20167660, NT2RP70031070,
NTONG20053730, PLACE60064180,
PLACE60095600, PROST20016760,
PROST20051310, PROST20058860,
PROST20152510, PUAEN20002470,
SKMUS20079150, SKNSH20030640,
SPLEN20023850, SPLEN20057830,
SPLEN20139360, SPLEN20190430,
TESTI20006830, TESTI20030200,
TESTI20031410, TESTI20035790,
TESTI20062120, TESTI20065650,
TESTI20081890, TESTI20150920,
TESTI20153310, TESTI20201760,
TESTI20212970, TESTI20227380,
TESTI20251740, TESTI20256560,
TESTI20260640, TESTI20270130,
TESTI20284260, TESTI20285230,
THYMU20021090, THYMU20049060,
THYMU20066660, THYMU20081110,
THYMU20090230, THYMU20120240,
UTERU10001060, UTERU20104310

The following 20 clones presumably belong to the category of protein synthesis- and/or protein transport-related proteins.

BRAMY20038980, BRAMY20274510,
CTONG20008190, CTONG20033610,
FCBBF20018680, FEBRA20090220,
KIDNE20141700, NT2NE20167660,
NTONG20055200, PLACE60012620,
PROST20036350, PROST20062820,
SKMUS20040440, SMINT20000070,
SPLEN20180980, TESTI20055680,
TESTI20067440, TESTI20107240,
THYMU20096580, THYMU20121040

The following 10 clones presumably belong to the category of cellular defense-related proteins.

ASTRO20089600, BRAMY20117670,
FEBRA20087550, HLUNG20081390,
MESAN20057240, NTONG20031580,
PROST20007600, SPLEN20023850,
SPLEN20043680, TESTI20261680

The following 19 clones presumably belong to the category of development and/or differentiation-related proteins.

CTONG20020950, HCBON10000150, MESAN20021470,
OCBBF20165910, PROST20155370, PUAEN20002470, TESTI20079220,
TESTI20079980, TESTI20166670, TESTI20184760, TESTI20252690,
TRACH20040390, UTERU20089620, UTERU20094830,
UTERU20169020

The following 168 clones presumably belong to the category of DNA- and/or RNA-binding proteins.

ASTRO20038400, BGGI120010750, BNGH420070370,
BRACE20003310, BRACE20061620, BRAMY20001510,
BRAMY20040580, BRAMY20076100, BRAMY20111780,
BRAMY20274510, BRAWH20040680, BRAWH20050740,
BRAWH20063010, BRAWH20080580, BRAWH20095900,
BRAWH20174330, BRSSN20066440, CTONG20020950,
CTONG20044230, CTONG20053990, CTONG20072930,
CTONG20074000, CTONG20165750, CTONG20186370,
CTONG20186520, DFNES20046840, DFNES20073320,
FCBBF20035430, FCBBF20070950, FCBBF30002270, FCBBF30003610,
FCBBF30019140, FCBBF30021900, FCBBF30048420, FCBBF30080730,
FCBBF30093170, FCBBF30114850, FCBBF30129010, FCBBF30136230,
FCBBF30220050, FCBBF30228940, FCBBF30236670, FCBBF30263080,
FCBBF30285930, FCBBF50003530, FEBRA20026820,
FEBRA20027070, FEBRA20035240, FEBRA20046510,
FEBRA20057010, FEBRA20063720, FEBRA20087550,
FEBRA20092760, FEBRA20170240, FEBRA20177800,
HCHON20002650, HEART20019310, HEART20063100,
HHDPC20081230, HLUNG20011460, HLUNG20014590,
HLUNG20028110, HLUNG20063700, HLUNG20068120,
KIDNE20140870, LIVER20006260, MESAN20016270,
MESAN20056890, MESAN20057240, NT2NE20038870,
NT2NE20053950, NT2NE20060750, NT2NE20079670,
NT2NE20082600, NT2NE20087270, NT2RP70029780,
NT2RP70046410, NT2RP70057500, NT2RP70075300, NT2RP70090870,
OCBBF20116250, OCBBF20120950, OCBBF20121910,
OCBBF20156450, OCBBF20157970, OCBBF20166900,
OCBBF20175360, OCBBF20177540, PEBLM10001470,
PEBLM20003260, PLACE60066970, PLACE60122970,
PLACE60177880, PROST20007170, PROST20024250,
PROST20035170, PROST20051310, PROST20058860,
PROST20151370, PROST20155370, PUAEN20003120,
SMINT20011950, SMINT20030740, SMINT20039050,
SMINT20044140, SMINT20086720, SPLEN20042200, SPLEN20043680,
SPLEN20055600, SPLEN20059270, SPLEN20063250, SPLEN20139360,
SPLEN20190430, TESTI10001570, TESTI20006830, TESTI20030200,
TESTI20031410, TESTI20035790, TESTI20057430, TESTI20059810,
TESTI20062120, TESTI20067480, TESTI20068790, TESTI20075240,
TESTI20079220, TESTI20088840, TESTI20104090, TESTI20134970,
TESTI20166670, TESTI20171070, TESTI20173960, TESTI20184760,
TESTI20197600, TESTI20201760, TESTI20212970, TESTI20227380,
TESTI20228740, TESTI20246480, TESTI20254030, TESTI20254990,
TESTI20266050, TESTI20268240, TESTI20270130, TESTI20274960,
TESTI20282530, TESTI20284260, TESTI20285230, THYMU10004280,
THYMU20019260, THYMU20023560, THYMU20032820,
THYMU20049060, THYMU20066660, THYMU20071120,

THYMU20077250, THYMU20081110, THYMU20090230, TKIDN10001920, TRACH20108240, UTERU10001060, UTERU20026620, UTERU20041630, UTERU20094830, UTERU20099510, UTERU20101150, UTERU20169020, UTERU20177150, UTERU20188670

The following 93 clones presumably belong to the category of ATP- and/or GTP-binding proteins.

ASTRO20026320, BNGH420035290, BRACE20050870, BRACE20079370, BRACE20200770, BRAMY20055760, BRAMY20118490, BRAMY20244490, BRAMY20251210, BRAWH20093040, BRAWH20190550, BRCAN10001050, BRCOC20003600, CTONG20008190, CTONG20030280, CTONG20032930, CTONG20176040, CTONG20184830, FCBBF20023490, FCBBF30019140, FCBBF30076310, FCBBF30105860, FCBBF30175350, FCBBF30201630, FCBBF30236670, FEBRA20005040, FEBRA20090160, FEBRA20173330, HCHON20000870, HLUNG20011260, HLUNG20052300, KIDNE20081170, KIDNE20134890, LIVER20030650, LIVER20055270, MESAN20065990, NT2NE20042550, NTONG20043080, NTONG20055200, OCBBF20182060, PLACE60054870, PLACE60064180, PLACE60095600, PLACE60140640, PROST20015210, PROST20033240, PROST20036350, PROST20051310, PROST20052850, PROST20062820, PROST20075280, PROST20120070, PUAEN20002470, SKNSH20052400, SKNSH20057920, SMINT20008110, SPLEN20023850, SPLEN20043680, SPLEN20049840, SPLEN20136730, SPLEN20180980, SPLEN20193790, TESTI20055680, TESTI20058920, TESTI20060080, TESTI20064650, TESTI20071130, TESTI20099350, TESTI20106820, TESTI20112860, TESTI20134680, TESTI20136010, TESTI20143180, TESTI20175370, TESTI20212970, TESTI20222460, TESTI20227380, TESTI20244220, TESTI20244460, TESTI20264530, THYMU20013250, THYMU20039320, THYMU20062610, THYMU20066660, THYMU20087270, THYMU20096580, THYMU20100940, THYMU20176010, TRACH20043360, TRACH20098510, TRACH20113020, UTERU20185220, UTERU20188670

Among the clones other than the ones shown above, BNGH420036410, FCBBF30257370 are clones which were predicted to highly possibly belong to the category of secretory protein and/or membrane protein based on the result of domain search by Pfam.

SMINT20044730, TESTI20140970

The two clones shown above are clones which were predicted to highly possibly belong to the category of glycoprotein-related protein based on the result of domain search by Pfam.

BRACE20055560, CTONG20046690, DFNES20043710, FCBBF30005500, MESAN20030350, MESAN20030370, PLACE60074820, TESTI20058350, TESTI20106170, TRACH20131230, UTERU20000950

The 11 clones shown above are clones which were predicted to highly possibly belong to the category of signal transduction-related protein based on the result of domain search by Pfam.

ASTRO20010290, BRACE20099070, CTONG20007660, DFNES20076340, DFNES20094820, FCBBF30125460, FCBBF30142290, FCBBF30169280, FEBRA20031000, NT2NE20026510, NT2RP70031340, PLACE50001390, SPLEN20135030, TESTI20046890, TESTI20060350, TESTI20166290, TESTI20259110, THYMU20184550

The 18 clones shown above are clones which were predicted to highly possibly belong to the category of transcription-related protein based on the result of domain search by Pfam.

ADRGL20047770, ADRGL20079060, BRACE20014450, BRACE20051600, BRAWH20185260, CTONG20033750, CTONG20070090, CTONG20190290, FCBBF20020440, FCBBF30005360, FCBBF3O173960, FEBRA20031000, KIDNE20087880, LIVER20013890, MESAN20030350, MESAN20030370, OCBBF20113110, PLACE60074820, PLACE60093380, PROST20028970, PROST20102190, SALGL10001070, SPLEN20006950, SPLEN20011350, SPLEN20050090, TESTI20060830, TESTI20066150, TESTI20120900, TESTI20132310, TESTI20148380, TESTI20162980, TESTI20166290, TESTI20205100, THYMU20112590, TRACH20029880

The 35 clones shown above are clones which were predicted to highly possibly belong to the category of enzyme and/or metabolism-related protein based on the result of domain search by Pfam.

PLACE60054820, TESTI20197030

The two clones shown above are clones which were predicted to highly possibly belong to the category of cell division and/or cell proliferation-related protein based on the result of domain search by Pfam.

ASTRO20006530, OCBBF20016390, TRACH20058000

The three clones shown above are clones which were predicted to highly possibly belong to the category of cytoskeleton-related protein based on the result of domain search by Pfam.

BRACE20065470, PLACE60054820

The two clones shown above are clones which were predicted to highly possibly belong to the category of nuclear protein and/or RNA synthesis-related protein based on the result of domain search by Pfam.

| |
|---|
| ASTRO20010290, BRACE20099070, BRAWH20014590, CTONG20007660, DFNES20076340, DFNES20094820, FCBBF30125460, FCBBF30142290, FCBBF30169280, FEBRA20031000, MESAN20034440, NT2NE20026510, NT2RP70031340, PLACE50001390, SPLEN20135030, TESTI20046890, TESTI20060350, TESTI20166290, TESTI20259110, THYMU20104480, THYMU20184550 |

The 21 clones shown above are clones which were predicted to highly possibly belong to the category of DNA- and/or RNA-binding protein based on the result of domain search by Pfam.

| |
|---|
| KIDNE20133880, MESAN20030350, MESAN20030370, TESTI20059480 |

The four clones shown above are clones which were predicted to highly possibly belong to the category of ATP- and/or GTP-binding proteins based on the result of domain search by Pfam.

The 205 clones shown below are clones which were unassignable to any of the above-mentioned categories, but have been predicted to have some functions based on homology search using their full-length nucleotide sequences and motif search in their estimated ORFs. Clone Name, Definition in the result of homology search or Motif Name in the motif search, demarcated by a double slash mark (//), are shown below.

ADRGL20022600//DIAPHANOUS PROTEIN HOMOLOG 1 (P140MDIA).
ADRGL20023920//ABC1 PROTEIN HOMOLOG PRECURSOR.
ASTRO20001910//*Rattus norvegicus* mRNA for annexin V-binding protein (ABP-10), partial cds.
ASTRO20009140//PUTATIVE COMPETENCE-DAMAGE PROTEIN.
ASTRO20046280//PSU1 PROTEIN.
ASTRO20058960//DNA damage inducible protein homolog—fission yeast (*Schizosaccharomyces pombe*)
BNGH420024870//C2 domain//C2 domain//C2 domain
BRACE20007330//RING CANAL PROTEIN (KELCH PROTEIN).
BRACE20052430//*Homo sapiens* AMSH mRNA, complete cds.
BRACE20054600//*Xenopus laevis* mRNA for Kielin, complete cds.
BRACE20059810//TSC-22/dip/bun family.
BRACE20063540//MEROZOITE SURFACE PROTEIN CMZ-8 (FRAGMENT).
BRACE20079200//*Xenopus laevis* mRNA for Kielin, complete cds.
BRAMY20016780//Proprotein convertase P-domain
BRAMY20023640//UBX domain
BRAMY20045420//Domain found in Dishevelled, Egl-10, and Pleckstrin
BRAMY20056840//UBE-1c2
BRAMY20063750//*Homo sapiens* HRIHFB2007 mRNA, partial cds.
BRAMY20102900//*Homo sapiens* RU1 (RU1) mRNA, complete cds.
BRAMY20158550//CALMODULIN.
BRAMY20223010//*Mus musculus* leucine-rich glioma-inactivated 1 protein precursor, (Lgi1) mRNA, complete cds.
BRAMY20238630//TETRATRICOPEPTIDE REPEAT PROTEIN 4.
BRAMY20245760//*Araneus diadematus* fibroin-4 mRNA, partial cds.
BRAWH20047790//HMG (high mobility group) box
BRSSN20005610//*Mus musculus* semaphorin cytoplasmic domain-associated protein 3A (Semcap3) mRNA, complete cds.
BRSSN20005660//Bacterial type II secretion system protein
BRSSN20093890//*Homo sapiens* mRNA for Kelch motif containing protein, complete cds.
CTONG20041150//*Streptomyces ansochromogenes* strain 7100 SanE (sanE) gene, complete cds.
CTONG20066110//*Homo sapiens* DEME-6 mRNA, partial cds.
CTONG20069420//Ribosomal protein S14p/S29e
CTONG20071040//BETA CRYSTALLIN B2 (BP).
CTONG20074170//DENN (AEX-3) domain
CTONG20083430//Nuclear transition protein 2
CTONG20170940//MYOTROPHIN (V-1 PROTEIN) (GRANULE CELL DIFFERENTIATION PROTEIN).
CTONG20174290//TRICHOHYALIN.
CTONG20174580//*Homo sapiens* mRNA for vascular Rab-GAP/TBC-containing protein complete cds.
CTONG20180690//Collagen triple helix repeat (20 copies)
CTONG20186550//cca3 protein—rat
CTONG20188080//TPR Domain
FCBBF10004760//*Homo sapiens* GAP-like protein (N61) mRNA, complete cds.
FCBBF20033360//RING CANAL PROTEIN (KELCH PROTEIN).
FCBBF20041380//SAM domain (Sterile alpha motif)
FCBBF20043730//UBA domain
FCBBF20056580//*Mus musculus* NSD1 protein mRNA, complete cds.
FCBBF20059660//TPR Domain
FCBBF30019180//SERINE/THREONINE PROTEIN PHOSPHATASE 2A, 65 KDA REGULATORY SUBUNIT A, ALPHA ISOFORM (PP2A, SUBUNIT A, PR65-ALPHA ISOFORM) (PP2A, SUBUNIT A, R1-ALPHA ISOFORM).
FCBBF30026580//*Homo sapiens* retinoblastoma-associated protein RAP140 mRNA, complete cds.
FCBBF30035570//C2 domain
FCBBF30079770//D-isomer specific 2-hydroxyacid dehydrogenases
FCBBF30100120//*Mus musculus* semaphorin cytoplasmic domain-associated protein 3A (Semcap3) mRNA, complete cds.
FCBBF30100410//*Mus musculus* testis-specific Y-encoded-like protein (Tspyl1) mRNA, complete cds.
FCBBF30118890//*Drosophila melanogaster* La related protein (larp) mRNA, partial cds.
FCBBF30138000//trg protein—rat
FCBBF30157270//*Rattus norvegicus* PAPIN mRNA, complete cds.
FCBBF30161780//gag gene protein p24 (core nucleocapsid protein)//Zinc knuckle
FCBBF30198670//dof protein—fruit fly (*Drosophila melanogaster*)
FCBBF30222910//*Mus musculus* Rap2 interacting protein 8 (RPIP8) mRNA, complete cds.
FCBBF30255680//*Rattus norvegicus* brain specific cortactin-binding protein CBP90 mRNA, partial cds.

FCBBF30260210//*Drosophila melanogaster* KISMET-L long isoform (kis) mRNA, complete cds.
FCBBF30282020//cca3 protein—rat
FCBBF40000610//late gestation lung 2 protein [*Rattus norvegicus*].
FEBRA20029620//Leucine Rich,Repeat//Leucine Rich Repeat//Leucine Rich Repeat
FEBRA20031150//*Homo sapiens* HSKM-B (HSKM-B) mRNA, complete cds.
FEBRA20038330//Corticotropin-releasing factor family
FEBRA20038970//*Homo sapiens* mRNA for stabilin-1 (stab1 gene).
FEBRA20088610//CELLULAR RETINALDEHYDE-BINDING PROTEIN (CRALBP).
FEBRA20150420//HYPOTHETICAL 131.5 KDA PROTEIN C02F12.7 IN CHROMOSOME X.
FEBRA20175330//D-isomer specific 2-hydroxyacid dehydrogenases
HEART10001420//*Mus musculus* skm-BOP1 (Bop) mRNA, complete cds.
HLUNG20024050//Rubredoxin
HLUNG20030420//*Mus musculus* mRNA for MAIL, complete cds.
HLUNG20030490//*Ambystoma tigrinum* RPE65 protein mRNA, complete cds.
HLUNG20033060//*Homo sapiens* GAP-like protein (N61) mRNA, complete cds.
HLUNG20041590//ubiquitous tetratricopeptide containing protein RoXaN [*Homo sapiens*].
HLUNG20045340//MOB2 PROTEIN (MPS1 BINDER 2).
HLUNG20051330//FHIPEP family
HLUNG20070410//Dihydropyridine sensitive L-type calcium channel (Beta subunit)
HLUNG20072100//*Gallus gallus* Dach2 protein (Dach2) mRNA, complete cds.
HLUNG20083480//Chicken mRNA for TSC-22 variant, complete cds, clone SLFEST52.
KIDNE20027980//SAM domain (Sterile alpha motif)
KIDNE20084730//*Homo sapiens* FH1/FH2 domain-containing protein FHOS (FHOS) mRNA, complete cds.
KIDNE20149780//NG28 [*Mus musculus*]
KIDNE20154330//*Rattus norvegicus* mRNA for multi PDZ domain protein.
KIDNE20170400//Leucine Rich Repeat//Leucine Rich Repeat//Leucine Rich Repeat//Protein kinase C terminal domain//Rubredoxin
KIDNE20189890//*Homo sapiens* mRNA for KARP-1-binding protein 2 (KAB2), complete cds.
LIVER20010760//*Homo sapiens* C-type lectin-like receptor-1 mRNA, complete cds.
LIVER20040740//RETINAL-BINDING PROTEIN (RALBP).
MESAN20009090//*Homo sapiens* CEGP1 protein (CEGP1), mRNA
MESAN20026870//PAN domain//TBC domain
MESAN20090190//CEGP1 protein [*Homo sapiens*].
NT2NE20059680//*Homo sapiens* integrin cytoplasmic domain associated protein (Icap-1a) mRNA, complete cds.
NT2NE20077270//Adenovirus EB1 55K protein/large t-antigen
NT2NE20087850//ANTER-SPECIFIC PROLINE-RICH PROTEIN APG (PROTEIN CEX) (FRAGMENT).
NT2NE20095230//*Homo sapiens* HSKM-B (HSKM-B) mRNA, complete cds.
NT2NE20108420//KES1 PROTEIN.
NT2NE20173970//*Rattus norvegicus* beta-catenin binding protein mRNA, complete cds.
NT2NE20177210//*Leishmania major* partial ppg1 gene for proteophosphoglycan.
NT2RP70012830//CALPHOTIN.
NT2RP70035110//*Caenorhabditis elegans* UNC-89 (unc-89) gene, complete cds.
NTONG20002230//*Mus musculus* RW1 protein mRNA, complete cds.
NTONG20005310//Ribosomal protein S9/S16
NTONG20029850//CALCYPHOSINE (R2D5 ANTIGEN).
NTONG20035150//RING CANAL PROTEIN (KELCH PROTEIN).
NTONG20058220//*Homo sapiens* phosphoprotein pp75 mRNA, partial cds.
OCBBF20005220//*Rattus norvegicus* Fos-related antigen mRNA, complete cds.
OCBBF20011860//*Mus musculus* epithelial protein lost in neoplasm-a (Eplin) mRNA, complete cds.
OCBBF20016810//enhancer of polycomb [*Mus musculus*]
OCBBF20147070//DNA polymerase (viral) C-terminal domain
OCBBF20160380//liver stage antigen LSA-1—*Plasmodium falciparum*
OCBBF20177910//Corticotropin-releasing factor family
PEBLM20005020//Virion host shutoff protein
PLACE60055460//*Homo sapiens* leucine-zipper protein FKSG13 (FKSG13) mRNA, complete cds.
PLACE60068710//SUPPRESSOR PROTEIN SRP40.
PLACE60080360//mucin [*Homo-sapiens*]
PLACE60082850//Pathogenesis-related protein Bet v I family
PLACE60098350//Human hepatocellular carcinoma associated protein (JCL-1) mRNA, complete cds.
PLACE60105680//*Homo sapiens* mRNA for TU12B1-TY, complete cds.
PLACE60119700//*Homo sapiens* mRNA for ABP32, complete cds.
PLACE60120280//SER/THR-RICH PROTEIN T10 IN DGCR REGION.
PLACE60132200//TRICHOHYALIN.
PLACE60181870//Pentaxin family
PROST20084470//*Plasmodium berghei* strain NYU2 merozoite surface protein-1 mRNA, partial cds.
PROST20087240//gag gene protein p24 (core nucleocapsid protein)
PROST20122490//*Gallus gallus* syndesmos mRNA, complete cds.
PROST20130320//S-100/ICaBP type calcium binding domain
PROST20152870//*Homo sapiens* APC2 gene, exon 14.
PUAEN10001640//*Mus musculus* cerebellar postnatal development protein-1 (Cpd1) mRNA, partial cds.
PUAEN20000800//Bleomycin resistance protein
SMINT20012220//Collagen triple helix repeat (20 copies)
SMINT20035510//*Drosophila melanogaster* La related protein (larp) mRNA, partial cds.
SMINT20036440//*Drosophila melanogaster* epsin-like protein mRNA, complete cds.
SMINT20038660//*Homo sapiens* HNOEL-iso (HNOEL-iso) mRNA, complete cds.
SMINT20043390//Ras association (RalGDS/AF-6) domain
SMINT20048720//Cytochrome P450//Cytochrome P450
SMINT20052130//*Rattus norvegicus* mRNA for gankyrin homologue, complete cds.
SMINT20054050//ABC1 PROTEIN HOMOLOG PRECURSOR.
SPLEN20024770//*Rattus norvegicus* (rsec6) mRNA, complete cds.

SPLEN20040780//CORNIFIN B (SMALL PROLINE-RICH PROTEIN 1B) (SPR1B) (SPR1 B).
SPLEN20041810//BC-2 protein [Homo sapiens]
SPLEN20100040//258.1 KDA PROTEIN C21ORF5 (KIAA0933).
SPLEN20104150//Ribosomal protein L36
SPLEN20116720//Homo sapiens misato mRNA, partial cds.
SPLEN20176130//Homo sapiens mRNA for ALEX1, complete cds.
SPLEN20181570//TRICHOHYALIN.
TESTI20004310//TRICHOHYALIN.
TESTI20016970//TPR Domain
TESTI20030440//TRICHOHYALIN.
TESTI20043180//mouse mRNA for megakaryocyte potentiating factor, complete cds.
TESTI20043910//IQ calmodulin-binding motif//IQ calmodulin-binding motif//IQ calmodulin-binding motif//IQ calmodulin-binding motif//IQ calmodulin-binding motif
TESTI20044900//Strongylocentrotus purpuratus radial spokehead mRNA, complete cds.
TESTI20046110//Extracellular link domain
TESTI20047930//Homo sapiens NY-REN-2 antigen mRNA, complete cds.
TESTI20049410//Proprotein convertase P-domain
TESTI20053950//IQ calmodulin-binding motif
TESTI20054700//Streptococcus pneumoniae strain g375 surface protein PspC (pspC) gene, pspC-8.1 allele, complete cds.
TESTI20055880//Serum amyloid A protein
TESTI20056030//Homo sapiens 88-kDa Golgi protein (GM88) mRNA, complete cds.
TESTI20061090//Keratin, high sulfur B2 protein
TESTI20064370//TPR Domain//TPR Domain//TPR Domain//TPR Domain// Synaptobrevin
TESTI20084250//OXYSTEROL-BINDING PROTEIN.
TESTI20092170//ENV polyprotein (coat polyprotein)
TESTI20116050//UBX domain
TESTI20120500//Kelch motif//Kelch motif
TESTI20126280//Mus musculus STAP mRNA for sperm tail associated protein, complete cds.
TESTI20144390//TESTIS-SPECIFIC PROTEIN PBS13.
TESTI20165990//Ribosomal protein L36
TESTI20169500//HYPOTHETICAL 51.9 KDA PROTEIN C27F1. 04C IN CHROMOSOME I.
TESTI20170280//Flagellar L-ring protein
TESTI20176450//thioredoxin interacting factor [Mus musculus].
TESTI20179230//Dihydropyridine sensitive L-type calcium channel (Beta subunit)
TESTI20180600//Homo sapiens HOM-TES-85 tumor antigen mRNA, complete cds.
TESTI20209050//HYPOTHETICAL 113.1 KDA PROTEIN IN PRE5-FET4 INTERGENIC REGION.
TESTI20210570//RETINAL-BINDING PROTEIN (RALBP).
TESTI20215310//Homo sapiens calcyclin binding protein mRNA, complete cds.
TESTI20247440//Human BLu protein testis isoform (BLu) mRNA, complete cds.
TESTI20249360//Homo sapiens DEME-6 mRNA, partial cds.
TESTI20250220//TRICHOHYALIN.
TESTI20251440//Rattus norvegicus (rsec6) mRNA, complete cds.
TESTI20255460//Mus musculus mRNA for MIWI (piwi), complete cds.
THYMU20009500//TPR Domain
THYMU20010180//MOB1 PROTEIN (MPS1 BINDER 1).
THYMU20013810//Human SEC7 homolog Tic (TIC) mRNA, complete cds.
THYMU20018250//TPR Domain
THYMU20026950//Mus musculus ROSA 26 transcription AS-ROSA26AS mRNA, complete cds.
THYMU20028410//Mus musculus Pax transcription activation domain interacting protein PTIP mRNA, complete cds.
THYMU20030460//Homo sapiens tumor endothelial marker 7 precursor (TEM7) mRNA, complete cds.
THYMU20031330//Homo sapiens putative nucleotide binding protein mRNA, complete cds.
THYMU20052460//PHORBOLIN I (FRAGMENTS).
THYMU20055450//Zona pellucida-like domain
THYMU20083830//Homo sapiens angiostatin binding protein 1 mRNA, complete cds.
THYMU20139160//Uncharacterized protein family UPF0031
THYMU20151610//Homo sapiens antigen NY—CO-1 (NY—CO-1) mRNA, complete cds.
TRACH20093400//TRICHOHYALIN.
TRACH20104510//Uncharacterized protein family UPF0005
TRACH20122980//HYPOTHETICAL PROTEIN MJ0798.
TRACH20139280//PX domain
TRACH20164810//D-isomer specific 2-hydroxyacid dehydrogenases
TRACH20165540//Human alpha-1 type I collagen gene surrounding osteogenesis imperfecta OI type II deletion.
UTERU20051790//guanylate kinase-interacting protein 1 Maguin-1, membrane-associated—rat
UTERU20083020//Domain of unknown function DUF71
UTERU20121140//Rhodanese-like domain
UTERU20128560//26.4 KDA PROTEIN IN RUVC-ASPS INTERGENIC REGION.
UTERU20132620//AXONEME-ASSOCIATED PROTEIN MST101(2).
UTERU20134830//pellino (Drosophila) homolog 2 [Homo sapiens]
UTERU20181270//Zinc knuckle Further, the reason is that a polypeptide does not always belong solely to a single category of the above-described functional categories, and therefore, a polypeptide may belong to any of the predicted functional categories. Besides, additional functions can be found for the clones classified into these functional categories by further analyses.

Since the polypeptide encoded by clones of the invention contains full-length amino acid sequence, it is possible to analyze its biological activity, and its effect on cellular conditions such as cell proliferation and differentiation by expressing the polypeptide as a recombinant polypeptide using an appropriate expression system, injecting the recombinant into the cell, or raising a specific antibody against the polypeptide.

The biological activities of respective polypeptides can be analyzed by the methods as shown below.

Secretory Protein, Transmembrane Protein:
"Ion Channels" (Ed., R. H. Ashley, 1995) of "The Practical Approach Series" (IRL PRESS),
"Growth Factors" (Eds., I. McKay, I. Leigh, 1993),
"Extracellular Matrix" (Eds., M. A. Haralson, J. R. Hassell, 1995);

Glycoprotein-Related Protein:
"Glycobiology" (Eds., M. Fukuda, A. Kobata, 1993) of "The Practical Approach Series" (IRL PRESS), "Glycoprotein Analysis in Biomedicine" (Ed., Elizabeth F. Hounsell, 1993) of "Method in Molecular Biology" (Humana Press) series;
Signal Transduction-Related Protein:
"Signal Transduction" (Ed., G. Milligan, 1992) of "The Practical Approach Series" (IRL PRESS),
"Protein Phosphorylation" (Ed., D. G. Hardie, 1993), or
"Signal Transduction Protocols" (Eds., David A. Kendall, Stephen J. Hill, 1995) of "Method in Molecular Biology" (Humana Press) series;
Transcription-Related Protein:
"Gene Transcription" (Eds., B. D. Hames, S. J. Higgins, 1993) of "The Practical Approach Series" (IRL PRESS),
"Transcription Factors" (Ed., D. S. Latchman, 1993);
Enzyme and/or Metabolism-Related Protein:
"Enzyme Assays" (Eds., ROBERT EISENTHAL and MICHAEL J. DANSON, 1992) of "The Practical Approach Series" (IRL PRESS);
Cell Division and/or Cell Proliferation-Related Protein:
"Cell Growth, Differentiation and Senescence" (Ed., GEORGE STUDZINSKI, 2000) of "The Practical Approach Series" (IRL PRESS);
Cytoskeleton-Related Protein:
"Cytoskeleton: Signalling and Cell Regulation" (Eds., KERMIT L. CARRAWAY and CAROLIE A. CAROTHERS CARRAWAY, 2000) of "The Practical Approach Series" (IRL PRESS),
"Cytoskeleton Methods and Protocols" (Ed., Gavin, Ray H., 2000) of "Method in Molecular Biology" (Humana Press) series;
Nuclear Protein and/or RNA Synthesis-Related Protein:
"Nuclear Receptors" (Ed., DIDIER PICARD, 1999) of "The Practical Approach Series" (IRL PRESS),
"RNA Processing" (Eds., STEPHEN J. HIGGINS and B. DAVID HAMES, 1994);
Protein Synthesis and/or Transport-Related Protein:
"Membrane Transport" (Ed., STEPHEN A. BALDWIN, 2000) of "The Practical Approach Series" (IRL PRESS),
"Protein Synthesis Methods and Protocols" (Eds., Martin, Robin, 1998) of "Method in Molecular Biology" (Humana Press) series;
Cellular Defense-Related Protein:
"DNA Repair Protocols" (Henderson, Daryl S., 1999) of "Method in Molecular Biology" (Humana Press) series,
"Chaperonin Protocols" (Eds., Schneider, Christine, 2000);
Development and/or Differentiation-Related Protein:
"Developmental Biology Protocols" (Eds., ROBERT EISENTHAL and MICHAEL J. DANSON, 1992) of "Method in Molecular Biology" (Humana Press) series;
DNA- and/or RNA-Binding Protein:
"DNA-Protein Interactions Principles and Protocols" (Eds., Kneale, G. Geoff, 1994) of "Method in Molecular Biology" (Humana Press) series,
"RNA-Protein Interaction Protocols" (Eds., Haynes, Susan R., 1999);
ATP- and/or GTP-Binding Protein:
"Signal Transduction Protocols" (Eds., David A. Kendall, Stephen J. Hill, 1995) of "Method in Molecular Biology" (Humana Press) series.

In the categorization, the clone predicted to belong to the category of secretory and/or membrane protein means a clone having hit data with some annotation, such as growth factor, cytokine, hormone, signal, transmembrane, membrane, extracellular matrix, receptor, G-protein coupled receptor, ionic channel, voltage-gated channel, calcium channel, cell adhesion, collagen, connective tissue, etc., suggesting that it was a secretory or membrane protein, or a clone in which the presence of nucleotide sequence encoding a signal sequence or transmembrane region was suggested by the results of PSORT and SOSUI analyses for deduced ORF.

The clone predicted to belong to the category of glycoprotein-related protein means a clone having hit data with some annotation, such as glycoprotein, suggesting that the clone encodes a glycoprotein-related protein.

The clone predicted to belong to the category of signal transduction-related protein means a clone having hit data with some annotation, such as serine/threonine-protein kinase, tyrosine-protein kinase, SH3 domain, SH2 domain, etc., suggesting that the clone encodes a signal transduction-related protein.

The clone predicted to belong to the category of transcription-related protein means a clone having hit data with some annotation, such as transcription regulation, zinc finger, homeobox, etc., suggesting that the clone encodes a transcription-related protein.

The clone predicted to belong to the category of disease-related protein means a clone having hit data with some annotation, such as disease mutation, syndrome, etc., suggesting that the clone encodes a disease-related protein, or a clone whose full-length nucleotide sequence has hit data for Swiss-Prot, GenBank, UmGene, or nr, where the hit data corresponds to genes or polypeptides which have been deposited in the Online Mendelian Inheritance in Man (OMIM), which is the human gene and disease database described later.

The clone predicted to belong to the category of enzyme and/or metabolism-related protein means a clone having hit data with some annotation, such as metabolism, oxidoreductase, E. C. No. (Enzyme commission number), etc., suggesting that the clone encodes an enzyme and/or metabolism-related protein.

The clone predicted to belong to the category of cell division and/or cell proliferation-related protein means a clone having hit data with some annotation, such as cell division, cell cycle, mitosis, chromosomal protein, cell growth, apoptosis, etc., suggesting that the clone encodes a cell division and/or cell proliferation-related protein.

The clone predicted to belong to the category of cytoskeleton-related protein means a clone having hit data with some annotation, such as structural protein, cytoskeleton, actin-binding, microtubles, etc., suggesting that the clone encodes a cytoskeleton-related protein.

The clone predicted to belong to the category of nuclear protein and/or RNA synthesis-related protein means a clone having hit data with some annotation, such as nuclear protein, RNA splicing, RNA processing, RNA helicase, polyadenylation, etc., suggesting that the clone encodes a nuclear protein and/or RNA synthesis-related protein.

The clone predicted to belong to the category of protein synthesis and/or transport-related protein means a clone having hit data with some annotation, such as translation regulation, protein biosynthesis, amino-acid biosynthesis, ribosomal protein, protein transport, signal recognition particle, etc., suggesting that the clone encodes a protein synthesis and/or transport-related protein.

The clone predicted to belong to the category of cellular defense-related protein means a clone having hit data with some annotation, such as heat shock, DNA repair, DNA damage, etc., suggesting that the clone encodes a cellular defense-related protein.

The clone predicted to belong to the category of development and/or differentiation-related proteins means a clone having hit data with some annotation, such as developmental protein, etc., suggesting that the clone encodes a development and/or differentiation-related protein.

The clone predicted to belong to the category of DNA- and/or RNA-binding protein means a clone having hit data with some annotation, such as DNA-binding, RNA-binding, etc.

The clone predicted to belong to the category of ATP- and/or GTP-binding protein means a clone having hit data with some annotation, such as ATP-binding, GTP-binding, etc.

As to a protein involved in a disease, it is possible to perform a functional analysis as described above, but also possible to analyze correlation between the expression or the activity of the protein and a certain disease by using a specific antibody that is obtained by using expressed protein. Alternatively, it is possible to utilize the database OMIM, which is a database of human genes and diseases, to analyze the protein. Further, new information is constantly being deposited in the OMIM database. Therefore, it is possible for one skilled in the art to find a new relationship between a particular disease and a gene of the present invention in the most up-to-date database. The proteins involved in diseases are useful for developing a diagnostic marker or medicines for regulation of their expression and activity, or as a target of gene therapy.

Also, as for a secretory protein, membrane protein, signal transduction-related protein, glycoprotein-related protein, or transcription-related protein, etc., search of the OMIM with the following keywords resulted in the finding that the proteins are involved in many diseases (the result of the OMIM search for secrete and membrane proteins is shown below). Also, association between proteins related to signal transduction or transcription and diseases is reported in "Transcription Factor Research-1999" (Fujii, Tamura, Morohashi, Kageyama, and Satake edit, (1999) Jikken-Igaku Zoukan, Vol.17, No.3), and "Gene Medicine" (1999) Vol.3, No.2). When cancer is used as an example, as described in "Biology of Cancer" (S. Matsubara, 1992) of Life Science series (Shokabo), many proteins are involved in cancers, which include enzyme and/or metabolism-related proteins, cytoskeleton-related proteins, cell division and/or cell proliferation-related proteins as well as secretory proteins, membrane proteins, signal transduction-related proteins, glycoprotein-related proteins, transcription-related proteins. As clearly seen by the above example, it is evident that not only disease-related proteins but also secretory proteins, membrane proteins, signal transduction-related proteins, glycoprotein-related proteins, transcription-related proteins, etc. are often involved in diseases, and thus they can be useful targets in the field of medical industry.

The result of the OMIM search for secretory and membrane proteins is shown below, in which the keywords,
(1) secretion protein,
(2) membrane protein,
(3) channel, and
(4) extracellular matrix were used.

Shown in the search result are only the accession numbers in the OMIM. Using the number, data showing the relationship between a disease and a gene or protein can be seen. The OMIM data has been renewed everyday.

1) Secretion Protein
354 entries found, searching for "secretion protein"
*604667, *104760, *176860, *151675, *139320, *107400, *604029, *118910, #200100, *176880, *603850, *147572, *604028, *179513, *125950, *139250, *246700, *600946, *600560, *602926, 185860, *605083, *603215, *602421, *157147, *179512, *600174, *109270, *604710, *138120, *179510, *600998, *179509, *170280, *179511, *600626, *603831, *601489, *154545, *179490, *603826, *122559, *603216, *102720, *147290, *164160, *603062, *112262, *602672, *605435, *605322, *131230, *601652, *603166, *601746, *601591, *179508, #160900, *104311, *600759, *147545, *167805, #104300, *167770, #219700, *168470, *601684, *602049, *601146, *605227, *602434, *602534, *114840, *603489, *604323, *107470, *600753, *600768, *118825, *600564, *604252, *173120, *134370, *192340, *308230, *600322, *605359, *600046, *300090, 106160, *600041, #262500, *605563, *150390, *158106, *182590, #103580, *104610, #173900, *134797, *143890, #145980, *306900, *308700, *176300, *227500, *137350, #154700, *138079, *600760, *107730, *142410, *147670, *124092, *590050, *152760, *600509, *605646, *201910, *227600, *152790, *300200, *300300, 300800, *138160, *107741, *120150, *601199, *120180, *120160, *176730, *133170, *122560, *107300, *137241, *120140, *101000, *193400, *217000, *272800, *600937, #201710, *600377, *174800, *106100, #274600, *173350, #177170, *147620, *214500, *131244, *202110, *120120, *601007, *191160, *147470, *603372, *600733, *252800, *190160, *138040, *158070, *162151, #125700, #130070, *113811, *603355, *171060, *136435, #184700, *603732, *190180, *164008, *186590, *120220, *604312, *152200, *138130, *605085, *605353, *600840, #166210, *188545, *207750, *173360, *601933, #194050, *153450, *138850, *253200, *307030, *157145, *600514, *600262, *264080, *147380, *600281, #204000, #227810, *232200, *188826, *232800, *161561, #166200, *188400, *153620, *182099, *218040, #265800, *172400, #177200, *176805, #211600, #214700, #176410, *152780, *600633, *601771, *301500, *605402, *601922, *307800, *147892, *147720, *312060, #520000, *147660, *106150, *602358, *107270, *601769, *147440, *604558, *131530, *600270, *601610, *603692, *603401, *600423, *601604, *603345, #125853, *602843, *142640, *603044, *605740, *134830, *602779, *130660, *139191, *137035, *600761, *601340, *600823, *107740, *130160, *600877, *605110, *600945, *130080, *600957, #130050, *605580, *118444, *601124, *124020, 122470, *120700, *603201, *137216, *601185, *138945, *218030, *600839, #240600, #262400, #162300, *162330, *188450, #265850, *263200, *162641, *300159, *601038, #191390, *201810, *601398, *602384, *131240, *602423, *139392, *142703, *602663, *232700, *602682, #602722, *602730, *600734, *188540, *182452, *601538, *603061, *146880, *603140, *603160, *142704, #252650, *182280, *125255, *603252, #131750, *182139, *182100, #259420, #261100, *603493, *601745, *182098, *603795, *123812, *600264, *147940, *180246, *180245, *118888, #604284, *168450, *118455, *604398, *604433, *601919, *118445, *600031, *604961, *605032, *605033, *171050, *171300, *131243, *109160, *605254, 274900, #171400, *600042, *151670, *184600, *605470, *605546, *176760, *602008, *102200, *605720, *600732, *605901

2) Membrane Protein
1489 entries found, searching for "membrane protein"
*130500, *605704, *305360, *153330, *173610, *109270, *170995, *170993, *104776, *602333, *309060, *605703, *120920, *605943, *602690, *159430, *600897, *133090, *601178, *602413, *602003, *604405, *605940, *603237, *109280, *600378, *602173, *107776, *602334, *602335, *125305, *601134, *.309845, *605731, *154045, *603241, *603718, *600594, *603214, *185881, *603657, *600182, *603177, *605331, *601476, *605456, *601114, *605190, *600723, *603904, *136950, *300222, *602879, *185880, *605348, *300096, *602257, *177070, *310200, *603062, *603344, *600039, *602977, *300100, *128240, *600959, *600322, *227400, *186945, *600946, *602534, *602048, *182900, *601097, *600267, *602625, *136430, *602421, *601047, *107450, *143450, *603141, *184756, *164730, *159440, *154050, *600579, *312080, *604202, *603700, *600447, *256540, *604691, *158343, *600403, *602414, *137290, *176640, *176981, *600179, *600754, *604456, *604693, *605875, *604605, *188860, *300172, *602910, *604323, *219800, *601848, *603179, *600279, *602251, #222700, *603831, *605072, *605377, *601028, *604155, *108733, *104225, *601896, *601510, *173335, *107770, *601767, *600046, *603850, *600040, *603784, *603234, 188560, *605863, *121015, *605862, *605861, *186946, *604252, *603215, *142461, *604597, *603143, *605264, *603735, *176860, *605536, *176801, *180721, *603355, *104760, *131560, *310300, *602631, *304700, #309400, *603142, *143890, *605431, *600753, *115501, *176790, *600266, *601691, *168468, *601239, *602216, #104300, *605613, *601595, *605550, *125950, *605475, *602217, *602261, *603534, *602262, *604631, *190315, *601313, *604306, *104311, *604672, *605000, *602461, *605548, *602296, *604376, *121014, *121011, *600691, *604262, *139310, *304040, *605445, *179514, *179512, *151460, #160900, *120130, *128239, *601158, *601403, *176943, *601014, 300800, *300294, *601757, *185470, *273800, *605034, *602887, #185000, *604871, *603593, *603583, *605454, *104775, *605872, *141180, *602713, *603531, *139150, *601531, *601832, *605452, *134651, *604156, *120620, *605883, *604142, *166945, *605324, *600816, *604699, *300112, *605182, *600164, *182180, *605071, *300023, *605057, *308240, *300249, *176947, *176894, *605081, *605035, *602044, *182860, *107271, *305100, *153390, *113730, *602689, *180069, *603518, *300017, *191275, *177061, *601693, *601789, *604241, *600934, *138160, *604424, *603868, *600174, *600718, *600523, *604141, *601009, *605251, *600481, *600874, *155550, *605227, *601017, *162230, 601138, *604157, *601212, *600763, *604110, *604158, *601107, *601326, 600621, *600587, 601137, *600917, *600855, *605058, *194355, *605194, *603291, *102720, *136425, *170715, *603216, *605547, *135630, *602926, *600168, *605002, *602474, *600157, *603025, *603893, *231200, *120090, *601966, *131230, *604722, *604721, *604515, *246700, *602101, *605628, *303630, *605787, *602857, *602285, *605708, *602488, *605025, *603817, *300051, *603293, *176878, *603646, 605707, 185860, *112205, *300187, *602654, *120070, *603648, *604850, *602655, *602514, *300118, *182309, *179590, *602701, *600759, *204200, *604170, *175100, #103580, *147670, *306400, *143100, *182870, *257220, *180380, #116920, *301000, *193300, *157147, *131550, *139200, *139130, *190195, *605406, *155760, *155960, *605734, *155970, *605385, *111700, *155975, *150370, 605709, *151430, *605438, *151510, *116952, *157655, *158105, *605777, *176877, *153619, *120131, *185430, *109190, *120190, *109170, *605093, *605250, *153432, *107777, *186590, *160993, *605699, *605698, *605813, *605697, *605616, *605300, *162060, *605219, *163970, *135620, *165040, *605478, *604964, *103195, *604932, *604923, *605906, *605496, *605914, *166490, 138277, *604915, *114070, *605213, *605933, *180297, *101000, *191163, *191164, *605101, *603167, *600772, *603164, *600708, *604001, *191328, *313440, *602672, *604009, *604299, *192974, *604256, *603048, *600515, *604221, *602632, *604196, *601179, 603290, *604661, *601023, *601110, *304800, *203200, *300212, *602933, *603352, *208900, *604418, *604838, *600551, #212140, *604837, *602049, *600552, *600553, *300213, *602574, *600583, *600932, *603452, *604775, *516020, *604617, *604464, *603498, *300145, *601523, *602694, *600632, *604762, *604492, *400015, *604504, *601717, *601728, *300242, *602426, *604194, *603821, *604730, *600695, *603823, *603869, *300241, *600707, *603822, *602370, *602202, *604193, *601181, *604089, *602507, *604195, *602306, *300284, *601805, *601895, *601275, *604660, *600752, *603820, *604192, *602207, *308230, *600894, *312600, *603199, *604029, *602500, *102680, *235200, #256300, *601633, #219700, 262890, *156225, *173470, *193400, *173910, *600354, *113705, *600065, *107741, *107400, *600024, *131195, *113811, #118220, *601638, *300011, *276903, *604144, *311770, *601758, #173900, *604592, *120120, *179605, *603130, *603372, *110750, *222900, *602509, *256100, *602469, *602281, *229300, *224100, *110900, *190180, *261600, *602997, *603616, *603189, 601791, *601567, *312700, *171060, *308700, *604027, *162643, *516000, *176261, *604028, *314850, #145980, *601383, *600930, *305900, *601253, *136350, *605537, *138140, *604033, *605070, *139250, *300500, *603967, *300041, *603866, #130600, *120150, *601050, *604942, *605204, *605248, *272750, *600163, *604235, *600682, *107266, *306900, *191092, #262500, *600106, *152790, *186720, *227650, *153700, *308380, *103390, *605646, *164920, *604478, #252650, *173850, *173350, *602505, *246530, *194380, *602575, *603030, #209920, *212138, #214100, *605767, *600582, *189980, #176200, *604653, *604678, *256550, *300037, *253700, #253300, #226700, *604766, #244400, *190000, *188040, *604824, *214500, #237500, *232300, *605014, *604477, *190930, *605124, *604475, *604594, #227810, *306700, #301050, *600135, *600143, *605145, #269920, *300104, *277900, *300135, *300231, *192500, *182138, *191190, *176805, *600185, *186591, *604889, *603051, *165360, *147545, *601040, #156575, *107269, *603009, *602934,

*123825, *601081, *602924, *163890, *600381, *602909, *150330, *109690, *123900, *603434, *603491, *110700, *602581, *125647, #154700, *114760, *141900, *603690, *120220, *601199, #145500, *601309, *602382, *120325, *600877, *604205, *604090, *601497, *602377, *605464, *138720, *603728, *120950, *604026, *600580, *601610, *137167, *603960, *603931, *601880, *603126, *138190, *130130, *601997, *601975, *600395, *516040, *600418, *600650, *605245, *605172, *600509, *164761, *310400, *600308, *605109, *600544, *600359, *600103, *605267, *312610, *176100, *308100, *158070, *605123, *173325, #312750, *600839, *158120, #604369, *604465, *173510, #161200, *151525, *605369, *604237, *516050, #600886, *604517, *165180, *605381, *605399, *307800, *604365, *155740, *147795, 601709, *604673, *147730, *602122, *147557, *193245, *600978, *604990, *603261, *603274, *601007, *131100, *602941, *107941, *146710, *276901, *131244, *602872, *603411, *186357, *176290, *601066, *185050, *232200, *143030, *601843, #236700, *604122, *142800, *134638, *604985, *182380, *603930, *142410, *137060, *604586, *601193, *120650, *252500, *253800, *120930, *604858, *605874, 601274, *602158, *605873, *193210, *203100, *601295, *604095, #201710, *126150, *108740, #205400, *601373, *300167, *109545, *602894, *603361, #300257, *266200, *603401, *131390, *180470, *605908, *604798, #221770, *223360, *180901, *605641, *605745, *604018, *300200, *604603, *230800, *602676, #604004, *605692, *602640, *601599, *134637, *245900, *118425, 601614, *605725, *120110, *300189, *300035, *603102, *250800, *602282, *602458, *123610, *603754, *300278, *601463, *300224, *601581, *182160, *601653, *139191, *601733, *600748, *142460, *601194, *152390, *153620, *601615, *601814, *601617, *601613, *300191, #308300, *600798, 601858, *601872, *601597, #601588, *600821, *147840, *152427, *138850, *600823, *601492, *300256, *600840, *300267, *601411, *139080, *139090, 600851, *300334, *179080, *602095, *601284, *601282, #177200, *601681, *601252, *176000, *602184, *602188, #266510, #154020, *186711, *257200, *601711, *600667, *602241, *186745, *255125, *300126, *600644, *123890, #255120, #175200, *600004, *302060, *123580, *186760, *122561, *602316, *600017, *120940, 140300, *151690, *120700, *602354, *600019, *600857, *182175, *600536, *158380, *600516, *120290, *600493, *182310, #252010, *182530, *186830, *601839, *142790, *159465, *118990, *250790, *248600, #248250, *186845, *601153, *142600, *116930, *114860, *171834, #303600, *186880, *600444, *142871, *601852, *602602, *602607, *114207, *186910, #232220, 600880, *134635, *112203, #112100, *111680, *231680, *311030, *111250, *111200, *134390, #226670, #145600, *226200, *602714, *171760, *133550, *602727, *161555, *602744, *602746, #131705, *602835, *600423, *176267, *602859, #600918, 277175, *602874, *601020, *109770, *600170, *217070, *173515, *602893, *147280, *154760, *171050, *108780, *176257, *600979, *600377, *108360, *204500, *170260, *146880, *154582, *601011, *600997, *602992, *201475, *603005, *190198, *147360, #270400,

*600238, #164970, *306250, #126600, *193065, #181350, *106180, *602136, *600937, *603086, *603087, *307030, *182099, *103320, *601683, #192430, *103180, *102681, *192321, *600244, *191740, *191315, *603152, *102642, *191305, #266140, *100500, *600867, *604585, *604404, *604345, *603201, *605430, *603207, *603208, *605433, *604101, *603969, *605896, *604616, *605851, *605768, *604576, *605754, *605730, *605477, *603263, *605538, *603283, *604402, *605453, *605427, *603302, *605458, 603313, *604415, *603345, *605541, *603353, *605295, *603879, *605268, *605266, *605246, *603377, *603380, *605181, *604203, *603425, *603867, *605106, *605017, *603842, *604936, *603510, *604857, *605932, *605816, *603765, *603551, *605357, *605237, *604204, *603594, *605110, *604190, *603861, *604962, *603639, *603644, *605007, *605349, *604943, *604918, *604907, *603667, *603681, *605396, *605561, *603712, *603713, *605688, *605942, *604878, *604843, *604659, *604671, *603798, *604682, *604056, *604705, *603749, 602586, *603647, *602515, #602475, *603717, *602359, *602372, *602380, *602518, *603652, *602573, *603626, 602587, *603598, *602871, *603613, *603750, *603875, *602608, *602666, *602345, *602935, *603564, *603548, *603927, 601876, *602343, *603943, *603787, *601730, *601611, *602679, *603788, *602243, 603790, *601535, *603796, *601488, *601485, *602314, *601478, *604047, *604048, *602297, *604057, *602715, *602192, *601459, *601416, *603833, *602190, *604102, *602106, *604111, *602724, *603499, *602736, *601123, *601002, *600923, *601987, *604149, *601929, *600910, *600900, *600864, *604165, *600782, *602836, *600769, *600742, *602783, *601905, *600535, *604198, *601901, *600534, *602876, *603356, *600530, *604216, *604217, *602890, *602905, *600465, *600464, *600446, *602891, *603366, *601894, *604272, *603926, *603312, *600368, *602914, *600327, *603151, *603202, 602911, *602974, *603006, *601883, *603008, *600074, *603007, *603046, #603903, *604433, *600016, *603925, *516005, *516004, *516003, *601756, *604487, *516001, *313475, *313470, #307810, *604527, *604528, *601745, *604551, *604555, *603243, *603242, *603061, *603063, *603217, *300335, *300283, *300281, *604600, *300197, *603097, *603220, *601625, *604623, *603118, *601590, *604646, *300008, *601568, *300007, *275630, *601533, #275200, *270200, #261550, *604031, *604683, #254800, *251100, #242300, *604058, *604720, *240500, *233690, #232240, #226730, *223100, *222100, #220100, *216950, *604832, 212750, 212067, *604066, *193067, 601315, *193001, *604862, *604870, *191306, *600385, *604879, *191191, *601296, *604914, *190181, *604119, #188550, *604925, *188410, #601287, *604939, *188380, *604126, *604945, *604148, *188060, *604982, *186854, *604988, *186360 *186355, *185250, *600916, *605008, *605009, 185020, *600734, *605024, *182331, *605032, *605033, *182305, *180903, #179800, *179610, *605060, *179410, *178990, *176802, *605080, *176266, *176263, *176260, *600732, *173490, *604199, *173445, *173391, 172290, *605147, *605149, *171890, *600528, *171833, *605185, #170500, *605193, #168000, *605196, *167055, *605205, *605208, 166900,

*605216, *162651, *162010, *600504, #161400, *604253, #160800, *159460, *154540, *605254, *605261, *153634, *600429, *153337, *600424, *605292, #604286, #152700, 152423, *152310, *151625, *600153, *604313, *151523, *150325, *150320, *150292, *603150, *150290, *150210, *605410, *605415, *605416, *605417, *605421, *603149, *604349, *147940, *600282, *147880, *146928, *146661, *600150, *146630, *142622, *600018, *605461, *138981, *138590, *600023, *138330, *605495, *138297, *605512, *138230, #136900, #301310, *516006, *605545, *605546, *136131, *134660, *134350, *516002, *605589, *131235, #130050, *605625, *126455, *126064, #125310, *605670, *604534, *125240, *123836, *123830, *123620, *605702, #122200, *120980, *120360, *118510, *114835, *605710, *605716, *605722, *114217, *604561, *113810, *111740, #110800, *605748, *605752, *604564, *110600, *603160, *109610, *605784, #107480, *107273, *603192, *300169, *106195, *105210, *104615, *104614, *104210, *103850, 103581, *605876, *605877, *605879, *103220, *605887, *300150, *102910, *102670, *102576, *605916, *604629, *102575, *102573, *300132, *101800, *605947

3) Channel (Member of Membrane Protein)
361 entries found, searching for "channel"
*176266, *600724, *182390, *123825, *114208, *114206, *176267, *114205, *601784, *600937, *114204, *603415, *600053, *114207, *114209, *605427, *604527, *604528, *600760, *601011, *192500, *118425, *600228, *176261, *602235, *600761, *600359, *300008, *182389, *600877, *602232, *176263, *182391, *601328, *600054, *603939, *602208, *601534, *600504, *602323, *603208, *601958, *603537, *601012, *601327, *600734, *602780, *602781, *604433, *603220, *182392, *605874, *605873, *601745, *603888, *603219, *602604, *603796, *302910, *602866, *601013, *602905, *602906, *603967, *600163, #170500, *152427, *180901, *176260, #601462, *603951, *601141, *604492, *600702, *602023, *600308, *602754, *107776, *176257, *602024, *601949, *605222, *601142, *602983, *193245, *600681, *176265, *600235, *176262, *176258, *605206, *604427, *605411, *603305, *601219, *600150, *604065, *602343, *605223, *605720, *603906, *138249, *138253, *600843, *604385, *600003, *600935, *603940, *602727, *602158, 602911, *600397, *602726, *600845, *605080, *600580, *602872, *602106, *176264, *603953, *605722, *300110, *138252, *604111, *602717, *602420, *600570, 600844, *603493, *600932, *605716, *138254, *603652, *300138, *605410, *176268, *605214, *605696, *300334, *604660, *176256, *605879, *603749, *603583, *602345, *604661, *603787, 603313, *602982, *604337, *600846, *604662, *300328, *300281, *602566, *602836, *604003, *603788, *603651, *602421, *107777, #177200, *100725, #219700, *100690, *100710, #160800, #603830, #183086, *600509, #220400, #601144, *173910, *180902, *605692, #264350, *160900, #145600, #255700, *602076, *603061, *601313, *154275, *604233, *604532, *108500, *121201, #170400, *300225, *121014, *139311, #125800, #160120, *118503, 601439, #141500, #168300, *304040, #601887, #256450, *186945, *154276, #300009, #216900, *600040,

*601014, *601042, *602512, *601383, *605445, *602368, *603831, #117000, *601218, *108745, *605248, #177735, #173900, *601212, *182139, *601059, *600039, *601485, *180903, *186360, *603319, #600101, *118509, *600109, #121200, *600170, *604187, *176975, *137163, #310468, #263800, #262300, *603750, *600229, *124030, *602251, #603829, *137143, #145500, *600669, *147450, *154050, *603353, *600516, *601157, *600855, *601154, *602522, *249210, *600968, #252650, *171060, *600919, *156490, #259700, #601678, *601764, #310500, *131244, *300041, *121011, *125950, *114180, *602974, *600637, *113730, *118504, *605145, *604669, *118800, *121013, *121015, *138491, *600421, *104610, *604045, *604594, *131230, *605487, *138247, *600467, #602485, *602481, *138251, *137192, *602403, 600851, *277900, *603785, *603152, *603199, *603475, #168600, #272120, *170280, *603852, #241200, *603053, *600465, #603034, *142461, *164920, *137164, *600884, *600442, *123885, *604001, *600232, *232200, *171050, *602103, *602014, *300211, *600983, *602887, *604415, *604418, *300242, #300071, *604471, *600837, 168350, *118511, 193007, *600300, *604654, #601820, *180297, *600046, *603853, *604678, *604693, #604772, *118508, *603855, *605204, #254210, *182099, *182307, #130600, *601109, *114080, *300103, *182860, *605438, *601129, *603964, *600019, *516060, #185000, *138079, *104210, *605818, *603418, *305990, *305450

4) Extracellular Matrix
218 entries found, searching for "extracellular matrix"
*605912, *603479, *602201, *604633, *601418, *601548, *115437, *154870, *600754, *602261, *602285, *602262, *134797, *120361, *604629, *604871, *603321, *603320, *601807, #154700, *116935, *185261, *120360, *185250, *605470, *603767, *253700, *190180, *128239, *308700, *276901, *193300, *120324, *188826, *602109, *155760, *600514, *600261, #177170, *600536, *147557, #116920, *150240, *601313, *120140, 601614, *605158, *120150, *120180, #200610, *605127, *193400, *192240, #173900, *152200, #136900, *135821, #130070, *120320, *120220, *112260, *310200, *600900, *600262, *605670, *600985, *179590, #245150, *602574, *601463, 183850, *601211, *604241, *600758, *186745, *604710, *602369, *602090, *190182, *192975, *602178, *230740, *600065, *601652, *158106, *190181, *156790, #158810, *193210, *155120, *192977, *193065, #226700, *187380, *231050, *182120, *188060, *186355, 163200, *164010, #156550, *151510, *150370, *253800, *156225, *150325, #194050, *150290, *216550, *147620, *600215, *222600, *147559, *165380, *182888, *600491, *146650, *146640, *600564, *600596, *600616, *600700, *600742, *138297, *182889, *154705, *600930, *301870, *153619, *601050, *601090, *601105, *165070, *305370, *135820, *130660, *310300, *601492, *128240, *601587, #126600, *601636, *600119, *601692, *601728, *125485, 601858, *601915, *602048, *175100, *602108, *121010, *600245, *120470, *120328, *120325, *602264, *120280, *602366, *600309, *602402, *602415, *602428, *602453, *602505, #166210, *602600, *602941, *603005, *603196, 603209, *603221, *603234, *603319, *120250, *120210,

*120120, *603489, *603551, *118938, *603799, *603842, *603924, *603963, *604042, *604063, *604149, *604160, *601028, *604467, *604510, *604592, *116930, *116806, *601284, *604724, *604806, *604807, *604808, *107269, *605007, *605008, *605009, *600214, *600076, *605174, *605175, *605292, *605343, *605351, #600204, *605497, *605546, *605587, *605623, *600211, *605702, *103320

In addition to these, the various keywords shown in the above-mentioned categorization or others can be used for the OMIM search and the result may suggest the involvement thereof in diseases.

Further, the use of nucleotide sequences of cDNAs of the present invention enables analyzing the expression frequency of genes corresponding to the cDNAs. In addition, functions of the genes can be predicted based on the information obtained by the expression frequency analysis.

There are several methods for analyzing the expression levels of genes involved in diseases. Differences in gene expression levels between diseased and normal tissues are studied by the analytical methods using, for example, Northern hybridization, RT-PCR, DNA microarray, etc. (Experimental Medicine, Vol.17, No. 8, 980–1056 (1999); Cell Engineering (additional volume) DNA Microarray and Advanced PCR Methods, Muramatsu & Nawa (eds.), Shujunsya (2000)). By computer analysis, in addition to these analysis methods, the nucleotide sequences of expressed genes can be compared to analyze the expression frequency. For example, there is a database called "BODYMAP"; gene clones are extracted at random from cDNA libraries of various tissues and/or cells, and the clones homologous to one another are assigned to a single cluster based on the information of nucleotide sequence homology at the 3'-end; genes are classified into any clusters, and the numbers of clones in the respective clusters are compared to gain the information on expression frequency.

When explicit difference in the expression levels between diseased tissues and normal tissues is observed for a gene by these analytical methods, it can be conclude that the gene is closely involved in a disease or disorder. Instead of diseased tissues, when gene expression is explicitly different between normal cells and cells reproducing disease-associated specific features, it can be concluded that the gene is closely involved in a disease or disorder.

From the 1970 clones whose full-length nucleotide sequences had been revealed, genes involved in particular pathology or functions were selected by the use of databases shown below (see Example 7; "Expression frequency analysis in silico"). The database used in the analyses of the present invention contains nucleotide sequences of 770,546 clones, and the population of the database is large enough for the analysis. The sequence information in the database was obtained by selecting cDNA clones at random from cDNA libraries derived from the various tissues and cells shown in Example 1 and determining the 5'-end sequences thereof.

Then, the nucleotide sequences of respective clones in this database were categorized (clustered) based on the nucleotide sequence homology determined with a search program; the number of clones belonging to every cluster of each library was determined and normalized; thus, the ratio of a certain gene in a cDNA library was determined. This analysis provided the information of the expression frequency of a gene in a tissue or cell that is the source of the cDNA library.

Then, in order to analyze the expression of genes corresponding to the nucleotide sequences of cDNAs of the present invention in tissues and cells, the libraries from the tissues or cells, which had been used in the large-scale cDNA analyses, were taken as subjects to compare the expression levels between different tissues or cells. Namely, the expression frequency was analyzed by comparing the previously normalized values between tissues or cells from which 600 or more cDNA clones whose nucleotide sequences had been analyzed were derived. The result of this analysis showed that the cDNA clones corresponded to the genes involved in the pathology and functions, which are indicated below. Each value in Tables 3 to 39 indicated below represents a relative expression frequency; the higher the value, the higher the expression level.

Osteoporosis-Related Genes

Osteoporosis is a pathology in which bones are easily broken owing to overall decrease in components of bone. The onset correlates to the balance between the functions of osteoblast producing bone and osteoclast absorbing bone, namely bone metabolism. Thus, the genes involved in the increase of osteoclasts differentiating from precursor cells of monocyte/macrophage line (Molecular Medicine 38. 642–648. (2001)) are genes involved in osteoporosis relevant to bone metabolism.

A nucleotide sequence information-based analysis was carried out to identify the genes whose expression frequencies are higher or lower in CD34+ cell (cell expressing a glycoprotein CD34) treated with the osteoclast differentiation factor (Molecular Medicine 38. 642–648. (2001)) than in the untreated CD34+ cell, which is the precursor cell of monocyte/macrophage line. The result of comparative analysis for the frequency between the cDNA libraries prepared from the RNA of CD34+ cells (CD34C) and from the RNA of CD34+ cells treated with the osteoclast differentiation factor (D30ST, D60ST or D90ST) showed that the genes whose expression levels were different between the two were 26 clones indicated in Table 3. These clones are involved in osteoporosis.

Genes Involved in Neural Cell Differentiation

Genes involved in neural cell differentiation are useful for treating neurological diseases. Genes with varying expression levels in response to induction of cellular differentiation in neural cells are thought to be involved in neurological diseases.

A survey was performed for genes whose expression levels are varied in response to induction of differentiation (stimulation by retinoic acid (RA) or growth inhibitor treatment after RA stimulation) in cultured cells of a neural strain, NT2. The result of comparative analysis of cDNA libraries derived from undifferentiated NT2 cells (NT2RM) and the cells subjected to the differentiation treatment (NT2RP, NT2RI or NT2NE) showed that the genes whose expression levels were different between the two were 193 clones indicated in Table 4. These genes are neurological disease-related genes.

Cancer-Related Genes

It has been assumed that, distinct from normal tissues, cancer tissues express a distinct set of genes, and thus the expression thereof can contribute to the carcinogenesis in tissues and cells. Thus, genes whose expression patterns in cancer tissues are different from those in normal tissues are cancer-related genes. Search was carried out for the genes whose expression levels in cancer tissues were different from those in normal tissues.

The result of comparative analysis of cDNA libraries derived from breast tumor (TBAES) and normal breast (BEAST) showed that the genes whose expression levels were different between the two were 4 clones indicated in Table 5.

The result of comparative analysis of cDNA libraries derived cervical tumor (TCERX) and normal cervical duct (CERVX) showed that the genes whose expression levels were different between the two was one clone indicated in Table 6.

The result of comparative analysis of cDNA libraries derived from colon tumor (TCOLN) and normal colon (COLON) showed that the genes whose expression levels were different between the two was one clone indicated in Table 7.

The result of comparative analysis of cDNA libraries derived from esophageal tumor (TESOP) and normal esophagus (NESOP) showed that the genes whose expression levels were different between the two were 6 clones indicated in Table 8.

The result of comparative analysis of cDNA libraries derived from kidney tumor (TKIDN) and normal kidney (KIDNE) showed that the genes whose expression levels were different between the two were 132 clones indicated in Table 9.

The result of comparative analysis of cDNA libraries derived from liver tumor (TLIVE) and normal liver (LIVER) showed that the genes whose expression levels were different between the two were 25 clones indicated in Table 10.

The result of comparative analysis of cDNA libraries derived from lung tumor (TLUNG) and normal lung (HLUNG) showed that the genes whose expression levels were different between the two were 99 clones indicated in Table 11.

The result of comparative analysis of cDNA libraries derived from ovary tumor (TOVER) and normal ovary (NOVER) showed the genes whose expression levels were different between the two were 3 clones indicated in Table 12.

The result of comparative analysis of cDNA libraries derived from stomach tumor (TSTOM) and normal stomach (STOMA) showed that the genes whose expression levels were different between the two were 15 clones indicated in Table 13.

The result of comparative analysis of cDNA libraries derived from uterine tumor (TUTER) and normal uterus (UTERU) showed that the genes whose expression levels were different between the two were 97 clones indicated in Table 14.

The result of comparative analysis of cDNA libraries derived from tongue cancer (CTONG) and normal tongue (NTONG) showed that the genes whose expression levels were different between the two were 203 clones indicated in Table 15.

These genes are involved in cancers.

Further, there is a method to search for genes involved in development and differentiation, which is the expression frequency analysis in which the expression levels of genes are compared between developing and/or differentiating tissues and/or cells and adult tissues and/or cells. The genes involved in tissue development and/or differentiation are genes participating in tissue construction and expression of function, and thus are useful genes, which are available for regenerative medicine aiming at convenient regeneration of injured tissues.

By using the information of gene expression frequency gained from the database of 5'-end nucleotide sequences described above, genes involved in development or differentiation of particular tissues were selected from the 1970 clones whose full-length nucleotide sequence had been revealed (see Example 7).

The result of comparative analysis of cDNA libraries derived from fetal brain (FCBBF, FEBRA or OCBBF) and adult brain (BRACE, BRALZ, BRAMY, BRAWH, BRCAN, BRCOC, BRHIP, BRSSN, BRSTN or BRTHA) showed that the genes whose expression levels were different between the two were 775 clones indicated in Tables 16 to 36.

The result of comparative analysis of cDNA libraries derived from fetal heart (FEHRT) and adult heart (HEART) showed that the genes whose expression levels were different between the two were 28 clones indicated in Table 37.

The result of comparative analysis of cDNA libraries derived from fetal kidney (FEKID) and adult kidney (KIDNE) showed that the genes whose expression levels were different between the two were 95 clones indicated in Table 38.

The result of comparative analysis of cDNA libraries derived from fetal lung (FELNG) and adult lung (HLUNG) showed that the genes whose expression levels were different between the two were 99 clones indicated in Table 39.

These genes are involved in regeneration of tissues and/or cells.

The expression frequency or the like can be analyzed by PCR based on the nucleotide sequences of cDNAs of the present invention. There are some known methods for comparing the quantities of amplification products obtained by PCR. For example, the band intensities can be determined by ethidium bromide staining. With RI-labeled or fluorescently labeled primers, the RI signal or fluorescence intensity can be assayed for the quantity of labeled amplification products. Alternatively, the quantity of amplification products can also be determined by measuring the RI signal or the fluorescence intensity from the RI-labeled or fluorescently labeled probe hybridizing to the products. The assay results thus obtained are compared and then the clones exhibiting differences in the expression levels can be selected.

There are some quantitative PCR methods: a PCR method using internal standards; a competitive PCR, in which the quantification is achieved by adding, to a sample, a dilution series of a known quantity of a template RNA and by comparing the quantity of an amplification product derived from the RNA of interest with the quantity of an amplification product derived from the template RNA. These methods overcome the problems of errors in the amount of amplification products among tubes and of the plateau effect. ATAC-PCR (Adaptor-tagged competitive PCR) is a method of competitive PCR which is practiced by using multiple adapters of different sizes attached to a gene whose 3'-end nucleotide sequence has previously been determined. The ratio of expression frequency of a single mRNA species from a number of tissues (cells) can be assayed in a single step (Nucleic Acids Research 1997, 25(22): 4694–4696; "DNA Micro-array and/Advanced PCR Techniques", Cell Technology, supplement, Eds., Muramatsu and Nawa (Shujunsha, 2000): 104–112).

If it is observed, by using these analytical methods, that the expression levels of genes are evidently varied during major cellular events (such as differentiation and apoptosis), the genes are involved in the cellular events and accordingly are candidates for disease- and/or disorder-related genes. Further, genes exhibiting tissue-specific expression are genes playing important parts in the tissue functions and, therefore, can be candidates for genes involved in diseases and/or disorders affecting the tissues.

For example, inflammation is an important biological response that is known to be involved in various diseases. The representative inflammation-inducing factors include TNF-α (Tumor Necrosis Factor-alpha). There exists a signaling cascade activated by TNF-α stimulations, wherein NF-κB is a transducing molecule (Cell 1995, 80:529–532). It has also been revealed that many inflammation-related genes, including IL-2, IL-6 and G-CSF, are varied in the expression levels thereof in response to the signal through the pathway (Trends Genet. 1999, 15(6): 229–235). It is assumed that genes whose expression levels are varied in response to the stimulation of TNF-α also participate in inflammation.

Further, the infection of *Helicobacter pylori* to the gastric epithelia is known to cause gastritis and gastroduodenal ulcer (Mebio 2000, July, 17(7): 16–33). Thus, the genes whose expression levels are altered depending on co-culturing cells with *Helicobacter pylori* may be involved in gastritis and gastroduodenal ulcer. A recent study has suggested that *Helicobacter pylori* strongly activates the NF-κB pathway (Gastroenterology 2000, 119: 97–108).

THP-1 cell, which is a human monocyte cell line, was cultured in the presence of TNF-α (Tumor Necrosis Factor-alpha). The genes whose expression levels were altered owing to the presence of TNF-α were searched for, and the result showed that the clones whose expression levels were increased owing to the presence of TNF-α were ASTRO20055530, ASTRO20055930,
ASTRO20088950, BRAMY20027390,
BRAMY20076130, BRAMY20118410,
BRAMY20125360, BRAMY20237190,
BRCAN20001480, BRHIP10000720,
CD34C20001750, CTONG20078340,
CTONG20085210, DFNES20063460,
FCBBF20029280, FCBBF20033360,
FCBBF30078600, FEBRA20007820,
FEBRA20031280, FEBRA20031810,
FEBRA20040290, HLUNG20041540,
HLUNG20092530, MESAN20021860,
MESAN20067430, MESAN20084150,
NT2NE20092950, NT2RP70031070,
OCBBF20012520, OCBBF20142290,
OCBBF20165900, OCBBF20170350,
OCBBF20176650, PLACE60006300,
PROST20011160, PROST20106060,
SPLEN20040780, SPLEN20110860,
SPLEN20177400, TESTI20030610,
TESTI20043130, TESTI20059370,
TEST120254480, THYMU10004280,
THYMU20030460, THYMU20062520,
THYMU20078240, THYMU20150190,
TRACH20090060, TRACH20125620,
UTERU20026620, UTERU20045200,
UTERU20064120, UTERU20103200.

On the other hand, the clones whose expression levels were decreased owing to the presence of TNF-α were BNGH420052350, BRACE20052530,
BRAMY20003880, CTONG20170940,
FCBBF30022680, FCBBF30225930,
FCBBF30257370, FEBRA20046280,
KIDNE20084030, KIDNE20188630,
NT2NE20082130, OCBBF20110210,
PLACE60061370, PROST20041460,
PROST20075280, PROST20110120,
SMINT20006020, TESTI20046540,
TESTI20057200, TEST120113940,
TESTI20257910, TESTI20262940,
TRACH20149740.

These clones are inflammation-related genes.

MKN45, which is a gastric cancer cell line, was co-cultured with *Helicobacter pylori*. The genes whose expression levels were altered owing to the presence of *Helicobacter pylori* were searched for, and the result showed that the clones whose expression levels were increased owing to the presence of *Helicobacter pylori* were BRAMY20028530, BRAMY20035380,
OCBBF20170350, PROST20011160,
SKMUS20091900, SPLEN20040780,
THYMU20078240, TRACH20190460,
UTERU20045200, UTERU20064120,
ASTRO20055530, CTONG20170940,
FEBRA20040290, MESAN20067430,
PROST20016760, THYMU10004280,
TRACH20090060, UTERU20041970,
OCBBF20142290, TESTI20030E10.

On the other hand, the clones whose expression levels were decreased owing to the presence of *Helicobacter pylori* were ASTRO20088950, BRACE20052530,
BRAMY20003880, BRAMY20027390,
BRAMY20036530, BRAMY20118410,
BRHIP20000210, FCBBF20032930,
FCBBF30022680, FCBBF30169870,
FEBRA20182030, KIDNE20182540,
LIVER20007750, MESAN20021220,
NT2NE20059210, NT2NE20082130,
OCBBF20155030, PROST20065100,
PROST20075280, SPLEN20110860,
TESTI20057200, TESTI20113940,
TESTI20149880, TESTI20151800,
TESTI20198600, TESTI20257910,
THYMU20046770, THYMU20058550,
THYMU20150190, FCBBF20033360,
FCBBF30257370, FEBRA20098040,
SMINT2000020.

These clones are involved in gastritis or gastroduodenal ulcer.

For example, if the polypeptide encoded by the cDNA of the present invention is a regulatory factor of cellular conditions such as growth and differentiation, it can be used for developing medicines as follows. The polypeptide or antibody provided by the invention is injected into a certain kind of cells by microinjection. Then, using the cells, it is possible to screen low molecular weight compounds, etc. by measuring the change in the cellular conditions, or the activation or inhibition of a particular gene. The screening can be performed as follows.

First, the polypeptide is expressed and purified as recombinant. The purified polypeptide is microinjected into cells such as various cell lines, or primary culture cells, and the cellular change such as growth and differentiation can be examined. Alternatively, the induction of genes whose expression is known to be involved in a particular change of cellular conditions may be detected by the amount of mRNA or polypeptide. Alternatively, the amount of intracellular molecules (low molecular weight compounds, etc.) that is changed by the function of the gene product (polypeptide) which is known to be involved in a particular change of cellular conditions may be detected. The compounds to be screened (both low and high molecular compounds are acceptable) can be added to the culture media and assessed for their activity by measuring the change of the cellular conditions.

Instead of microinjection, cell lines introduced with the gene obtained in the invention can be used for the screening. If the gene product is turn out to be involved in a particular change in the cellular conditions, the change of the product can be used as a measurement for screening. Once a compound is screened out which can activate or inhibit the function of the polypeptide of the invention, it can be applied for developing medicines.

If the polypeptide encoded by the cDNA of the present invention is a secretory protein, membrane protein, or protein involved in signal transduction, glycoprotein, transcription, or diseases, it can be used in functional assays for developing medicines.

In case of a membrane protein, it is most likely to be a polypeptide that functions as a receptor or ligand on the cell surface. Therefore, it is possible to reveal a new relationship between a ligand and receptor by screening the membrane protein of the invention based on the binding activity with the known ligand or receptor. Screening can be performed according to the known methods.

For example, a ligand against the polypeptide of the invention can be screened in the following manner. Namely, a ligand that binds to a specific polypeptide can be screened by a method comprising the steps of: (a) contacting a test sample with the polypeptide of the invention or a partial peptide thereof, or cells expressing these, and (b) selecting a test sample that binds to said polypeptide, said partial peptide, or said cells.

On the other hand, for example, screening using cells expressing the polypeptide of the present invention that is a receptor protein can also be performed as follows. It is possible to screen receptors that is capable of binding to a specific polypeptide by using procedures (a) attaching the sample cells to the polypeptide of the invention or its partial peptide, and (b) selecting cells that can bind to the said polypeptide or its partial peptide.

In a following screening as an example, first the polypeptide of the invention is expressed, and the recombinant polypeptide is purified. Next, the purified polypeptide is labeled, binding assay is performed using a various cell lines or primary cultured cells, and cells that are expressing a receptor are selected (Growth and differentiation factors and their receptors, Shin-Seikagaku Jikken Kouza Vol.7 (1991) Honjyo, Arai, Taniguchi, and Muramatsu edit, p203–236, Tokyo-Kagaku-Doujin). A polypeptide of the invention can be labeled with RI such as $^{125}I$, and enzyme (alkaline phosphatase etc.).

Alternatively, a polypeptide of the invention may be used without labeling and then detected by using a labeled antibody against the polypeptide. The cells that are selected by the above screening methods, which express a receptor of the polypeptide of the invention, can be used for the further screening of an agonists or antagonists of the said receptor.

Once the ligand binding to the polypeptide of the invention, the receptor of the polypeptide of the invention or the cells expressing the receptor are obtained by screening, it is possible to screen a compound that binds to the ligand and receptor. Also it is possible to screen a compound that can inhibit both bindings (agonists or antagonists of the receptor, for example) by utilizing the binding activities.

When the polypeptide of the invention is a receptor, the screening method comprises the steps of (a) contacting the polypeptide of the invention or cells expressing the polypeptide of the invention with the ligand, in the presence of a test sample, (b) detecting the binding activity between said polypeptide or cells expressing said polypeptide and the ligand, and (c) selecting a compound that reduces said binding activity when compared to the activity in the absence of the test sample. Furthermore, when the polypeptide of the invention is a ligand, the screening method comprises the steps of (a) contacting the polypeptide of the invention with its receptor or cells expressing the receptor in the presence of samples, (b) detecting the binding activity between the polypeptide and its receptor or the cells expressing the receptor, and (c) selecting a compound that can potentially reduce the binding activity compared to the activity in the absence of the sample.

Samples to screen include cell extracts, expressed products from a gene library, synthesized low molecular compound, synthesized peptide, and natural compounds, for example, but are not construed to be listed here. A compound that is isolated by the above screening using a binding activity of the polypeptide of the invention can also be used as a sample.

A compound isolated by the screening may be a candidate to be an agonist or an antagonist of the receptor of the polypeptide. By utilizing an assay that monitors a change in the intracellular signaling such as phosphorylation which results from reduction of the binding between the polypeptide and its receptor, it is possible to identify whether the obtained compound is an agonist or antagonist of the receptor. Also, the compound may be a candidate of a molecule that can inhibit the interaction between the polypeptide and its associated proteins (including a receptor) in vivo. Such compounds can be used for developing drugs for precaution or cures of a disease in which the polypeptide is involved.

Secretory proteins may regulate cellular conditions such as growth and differentiation. It is possible to find out a novel factor that regulates cellular conditions by adding the secretory protein of the invention to a certain kind of cell, and performing a screening by utilizing the cellular changes in growth or differentiation, or activation of a particular gene.

The screening can be performed, for example, as follows. First, the polypeptide of the invention is expressed and purified in a recombinant form. Then, the purified polypeptide is added to a various kind of cell lines or primary cultured cells, and the change in the cell growth and differentiation is monitored. The induction of a particular gene that is known to be involved in a certain cellular change is detected by the amounts of mRNA and polypeptide. Alternatively, the amount of an intracellular molecule (low-molecular-weight compounds, etc.) that is changed by the function of a gene product (polypeptide) that is known to function in a certain cellular change is used for the detection.

Once the screening reveals that the polypeptide of the invention can regulate cellular conditions or the functions, it is possible to apply the polypeptide as a pharmaceutical and diagnostic medicine for related diseases by itself or by altering a part of it into an appropriate composition.

As is above described for membrane proteins, the secretory protein provided by the invention may be used to explore a novel ligand-receptor interaction using a screening based on the binding activity to a known ligand or receptor. A similar method can be used to identify an agonist or antagonist. The resulting compounds obtained by the methods can be a candidate of a compound that can inhibit the interaction between the polypeptide of the invention and an interacting molecule (including a receptor). The compounds may be able to use as a preventive, therapeutic, and diagnostic medicine for the diseases, in which the polypeptide may play a certain role.

Proteins involved in signal transduction or transcription may be a factor that affects a certain polypeptide or gene in response to intracellular/extracellular stimuli. It is possible to find out a novel factor that can affect a polypeptide or gene by expressing the polypeptide provided by the invention in a certain types of cells, and performing a screening utilizing the activation of a certain intracellular polypeptide or gene.

The screening may be performed as follows. First, a transformed cell line expressing the polypeptide is obtained. Then, the transformed cell line and the untransformed original cell line are compared for the changes in the expression of a certain gene by detecting the amount of its mRNA or polypeptide. Alternatively, the amount of an intracellular molecule (low molecular weight compounds, etc.) that is changed by the function of a certain gene product (polypeptide) may be used for the detection. Furthermore, the change of the expression of a certain gene can be detected by introducing a fusion gene that comprises a regulatory region of the gene and a marker gene (luciferase, β-galactosidase, etc.) into a cell, expressing the polypeptide provided by the invention into the cell, and estimating the activity of a marker gene product (polypeptide).

If the polypeptide or gene of the invention is involved in diseases, it is possible to screen a gene or compound that can regulate its expression and/or activity either directly or indirectly by utilizing the polypeptide of the present invention.

For example, the polypeptide of the invention is expressed and purified as a recombinant polypeptide. Then, the polypeptide or gene that interacts with the polypeptide of the invention is purified, and screened based on the binding. Alternatively, the screening can be performed by adding with a compound of a candidate of the inhibitor added in advance and monitoring the change of binding activity. In another method, a transcription regulatory region locating in the 5'-upstream of the gene encoding the polypeptide of the invention that is capable of regulating the expression of other genes is obtained, and fused with a marker gene. The fusion is introduced into a cell, and the cell is added with compounds to explore a regulatory factor of the expression of the said gene.

The compound obtained by the screening can be used for developing pharmaceutical and diagnostic medicines for the diseases in which the polypeptide of the present invention is involved. Similarly, if the regulatory factor obtained in the screening is turn out to be a polypeptide, compounds that can newly affect the expression or activity of the polypeptide may be used as a medicine for the diseases in which the polypeptide of the invention is involved.

If the polypeptide of the invention has an enzymatic activity, regardless as to whether it is a secretory protein, membrane protein, or proteins involved in signal transduction, glycoprotein, transcription, or diseases, a screening may be performed by adding a compound to the polypeptide of the invention and monitoring the change of the compound. The enzymatic activity may also be utilized to screen a compound that can inhibit the activity of the polypeptide.

In a screening given as an example, the polypeptide of the invention is expressed and the recombinant polypeptide is purified. Then, compounds are contacted with the purified polypeptide, and the amount of the compound and the reaction products is examined. Alternatively, compounds that are candidates of an inhibitor are pretreated, then a compound (substrate) that can react with the purified polypeptide is added, and the amount of the substrate and the reaction products is examined.

The compounds obtained in the screening may be used as a medicine for diseases in which the polypeptide of the invention is involved. Also they can be applied for tests that examine whether the polypeptide of the invention functions normally in vivo.

Whether the secretory protein, membrane protein, signal transduction-related protein, glycoprotein-related protein, or transcription-related protein of the present invention is a novel protein involved in diseases or not is determined in another method than described above, by obtaining a specific antibody against the polypeptide of the invention, and examining the relationship between the expression or activity of the polypeptide and a certain disease. In an alternative way, it may be analyzed referred to the methods in "Molecular Diagnosis of Genetic Diseases" (Elles R. edit, (1996) in the series of "Method in Molecular Biology" (Humana Press).

Proteins involved in diseases are targets of screening as mentioned, and thus are very useful in developing drugs which regulate their expression and activity. Also, the proteins are useful in the medicinal industry as a diagnostic marker of the related disease or a target of gene therapy.

Compounds isolated as mentioned above can be administered patients as it is, or after formulated into a pharmaceutical composition according to the known methods. For example, a pharmaceutically acceptable carrier or vehicle, specifically sterilized water, saline, plant oil, emulsifier, or suspending agent can be mixed with the compounds appropriately. The pharmaceutical compositions can be administered to patients by a method known to those skilled in the art, such as intraarterial, intravenous, or subcutaneous injections. The dosage may vary depending on the weight or age of a patient, or the method of administration, but those skilled in the art can choose an appropriate dosage properly. If the compound is encoded by polynucleotide, the polynucleotide can be cloned into a vector for gene therapy, and used for gene therapy. The dosage of the polynucleotide and the method of its administration may vary depending on the weight or age of a patient, or the symptoms, but those skilled in the art can choose properly.

The present invention further relates to databases comprising at least a sequence of polynucleotide and/or polypeptide, or a medium recorded in such databases, selected from the sequence data of the nucleotide and/or the amino acids indicated in Table 1. The term "database" means a set of accumulated information as machine-searchable and readable information of nucleotide sequence. The databases of the present invention comprise at least one of the novel nucleotide sequences of polynucleotides provided by the present invention. The databases of the present invention can consist of only the sequence data of the novel polynucleotides provided by the present invention or can comprise other information on nucleotide sequences of known full-length cDNAs or ESTs. The databases of the present invention can be comprised of not only the information on the nucleotide sequences but also the information on the gene functions revealed by the present invention. Additional information such as names of DNA clones carrying the full-length cDNAs can be recorded or linked together with the sequence data in the databases.

The database of the present invention is useful for gaining complete gene sequence information from partial sequence information of a gene of interest. The database of the present invention comprises nucleotide sequence information of full-length cDNAs. Consequently, by comparing the information in this database with the nucleotide sequence of a partial gene fragment yielded by differential display method or subtraction method, the information on the full-length nucleotide sequence of interest can be gained from the sequence of the partial fragment as a starting clue.

The sequence information of the full-length cDNAs constituting the database of the present invention contains not only the information on the complete sequences but also extra information on expression frequency of the genes as well as homology of the genes to known genes and known polypeptides. Thus the extra information facilitates rapid functional analyses of partial gene fragments. Further, the information on human genes is accumulated in the database of the present invention, and therefore, the database is useful for isolating a human homologue of a gene originating from other species. The human homologue can be isolated based on the nucleotide sequence of the gene from the original species.

At present, information on a wide variety of gene fragments can be obtained by differential display method and subtraction method. In general, these gene fragments are utilized as tools for isolating the full-length sequences thereof. When the gene fragment corresponds to an already-known gene, the full-length sequence is easily obtained by comparing the partial sequence with the information in known databases. However, when there exists no information corresponding to the partial sequence of interest in the known databases, cDNA cloning should be carried out for the full-length cDNA. It is often difficult to obtain the full-length nucleotide sequence using the partial sequence information as an initial clue. If the full-length of the gene is not available, the amino acid sequence of the polypeptide encoded by the gene remains unidentified. Thus the database of the present invention can contribute to the identification of full-length cDNAs corresponding to gene fragments, which cannot be revealed by using databases of known genes.

The present invention has provided 1970 polynucleotides. As has not yet proceeded the isolation of full-length cDNA within the human, the invention has great significance. It is known that secretory proteins, membrane proteins, signal transduction-related proteins, glycoprotein-related proteins, transcription-related proteins, and so on are involved in many diseases. The genes and proteins involved in diseases are useful for developing a diagnostic marker or medicines for regulation of their expression and activity, or as a target of gene therapy.

In particular, cDNA assumed to encode secretory proteins, which were provided by this invention, are very important for the industry since the encoded proteins themselves are expected to be useful as pharmaceutical agents and many disease-related genes may be included in them. In addition, membrane proteins, signal transduction-related proteins, transcription-related proteins, disease-related proteins, and genes encoding them can be used as indicators for diseases, etc. These cDNA are also very important for the industry, which are expected to regulate the activity or expression of the encoded protein to treat diseases, etc.

Any patents, patent applications, and publications cited herein are incorporated by reference.

The invention is illustrated more specifically with reference to the following examples, but is not to be construed as being limited thereto.

EXAMPLE 1

Preparation of cDNA Library by Oligo-Capping
(1) Extraction and Purchase of mRNA Total RNAs as mRNA sources were extracted from human tissues (shown below) by the method as described in the reference (J. Sambrook, E. F. Fritsch & T. Maniatis, Molecular Cloning Second edition, Cold Spring harbor Laboratory Press, 1989). Further, by the method as described in the reference (J. Sambrook, E. F. Fritsch & T. Maniatis, Molecular Cloning Second edition, Cold Spring harbor Laboratory Press, 1989), total RNAs as mRNA sources were extracted from human culture cells and human primary culture cells (shown below) which had been cultivated by the methods described in the catalogs.

The library names and the origins are indicated below in the order of "Library name: Origin". When a library was prepared by the subtraction method, the item is followed by a description of how to prepare the subtracted library.
<Extraction of mRNA from Human Tissues>
NTONG: Normal tongue;
CTONG: Tongue cancer;
FCBBF: Fetal brain;
OCBBF: Fetal brain;
PLACE: Placenta;
SYNOV: Synovial membrane tissue (from rheumatioid arthritis).
<Extraction of mRNA from Culture Cells>
BNGH4: H4 cells (ATCC #HTB-148);
IMR32: IMR32 cells (ATCC-#CCL-127);
SKNMC: SK-N-MC cells (ATCC #HTB-10);
3NB69: NB69 cells (RCB #RCB0480);
BGGI1: GI1 cells (RCB #RCB0763);
NB9N4: NB9 cells (RCB #RCB0477);
SKNSH: SK-N-SH cells (RCB #RCB0426);
NT2RM: NT2 cells (STARATAGENE #204101);
NT2RP: NT2 cells treated with retinoic acid (RA) for 5 weeks to induce the differentiation;
NT2RI: NT2 cells treated with RA for 5 weeks to induce the differentiation, followed by the treatment with the growth inhibitor for 2 weeks;
NT2NE: NT2 cells were treated with RA and the growth inhibitor for the neuronal differentiation, and the resultant neurons were concentrated and harvested (NT2 Neuron);
NTISM: NT2 cells (STARATAGENE #204101) were treated with RA for 5 weeks to induce the differentiation, and then treated with the growth inhibitor for 2 weeks; mRNA was prepared from the cells and a cDNA library was constructed from the mRNA; the cDNAs of the library whose nucleotide sequences were shared by those of mRNAs from undifferentiated NT2 cells were subtracted by using a Subtract Kit (Invitrogen #K4320-01); the subtracted library (NT2RI-NT2RM) was provided by this procedure.

RCB indicates that the cell was provided by the Cell Bank, RIKEN GENE BANK, The Institute of Physical and Chemical Research; ATCC indicates that the cell was provided by American Type Culture Collection.
<Extraction of mRNA from Primary Culture Cells>
ASTRO: Normal human astrocyte NHA5732, Takara Shuzo #CC2565;
DFNES: Normal human dermal fibroblast (neonatal skin); NHDF-Neo NHDF2564, Takara Shuzo #CC2509;
MESAN: Normal human mesangial cell NHMC56046-2, Takara Shuzo #CC2559;
NHNPC: Normal human neural progenitor cell NHNP5958, Takara Shuzo #CC2599;
PEBLM: Normal human peripheral blood mononuclear cell HPBMC5939, Takara Shuzo #CC2702;

HSYRA: Human synoviocyte HS-RA (from rheumatioid arthritis), Toyobo #T404K-05;
PUAEN: Normal human pulmonary artery endothelial cells, Toyobo #T302K-05;
UMVEN: Normal human umbilical vein endothelial cell HUVEC, Toyobo #T200K-05;
HCASM: Normal human coronary artery smooth muscle cell HCASMC, Toyobo #T305K-05;
HCHON: Normal human chondrocyte HC, Toyobo #T402K-05;
HHDPC: Normal human dermal papilla cell HDPC, Toyobo #THPCK-001;
CD34C: CD34+ cells (AllCells, LLC #CB14435M);
D3OST: CD34+ cells treated with the osteoclast differentiation factor (ODF) for 3 days to induce the differentiation;
D6OST: CD34+ cells treated with ODF for 6 days to induce the differentiation;
D9OST: CD34+ cells treated with ODF for 9 days to induce the differentiation.

Then, total RNAs extracted from the following human tissues were purchased and used as mRNA sources. The library names and the origins are indicated below in the order of "Library name: Origin". When a library was prepared by the subtraction method, the item is followed by a description of how to prepare the subtracted library.
<Purchase of Total RNA Containing mRNA Extracted from Human Tissues>
ADRGL: Adrenal gland, CLONTECH #64016-1;
BRACE: Brain (cerebellum), CLONTECH #64035-1;
BRAWH: Whole brain, CLONTECH #64020-1;
FEBRA: Fetal brain, CLONTECH #64019-1;
FELIV: Fetal liver, CLONTECH #64018-1;
HEART: Heart, CLONTECH #64025-1;
HLUNG: Lung, CLONTECH #64023-1;
KIDNE: Kidney, CLONTECH #64030-1;
LIVER: Liver, CLONTECH #64022-1;
MAMGL: Mammary Gland, CLONTECH #64037-1;
PANCR: Pancreas, CLONTECH #64031-1;
PROST: Prostate, CLONTECH #64038-1;
SALGL: Salivary Gland, CLONTECH #64026-1;
SKMUS: Skeletal Muscle, CLONTECH #64033-1;
SMINT: Small Intestine, CLONTECH #64039-1;
SPLEN: Spleen, CLONTECH #64034-1;
STOMA: Stomach, CLONTECH #64090-1;
TBAES: Breast (Tumor), CLONTECH #64015-1;
TCERX: Cervix (Tumor), CLONTECH #64010-1;
TCOLN: Colon (Tumor), CLONTECH #64014-1;
TESTI: Testis, CLONTECH #64027-1;
THYMU: Thymus, CLONTECH #64028-1;
TLUNG: Lung (Tumor), CLONTECH #64013-1;
TOVAR: Ovary (Tumor), CLONTECH #64011-1;
TRACH: Trachea, CLONTECH #64091-1;
TUTER: Uterus (Tumor), CLONTECH #64008-1;
UTERU: Uterus, CLONTECH #64029-1;
ADIPS: Adipose, Invitrogen #D6005-01;
BLADE: Bladder, Invitrogen #D6020-01;
BRALZ: Cerebral cortex from an Alzheimer patient (Brain, cortex, Alzheimer), Invitrogen #D6830-01;
CERVX: Cervix, Invitrogen #D6047-01;
COLON: Colon, Invitrogen #D6050-0;
NESOP: Esophagus, Invitrogen #D6060-01;
PERIC: Pericardium, Invitrogen #D6105-01;
RECTM: Rectum, Invitrogen #D6110-01;
TESOP: Esophageal (Tumor), Invitrogen #D6860-01;
TKIDN: Kidney (Tumor), Invitrogen #D6870-01;
TLIVE: Liver (Tumor), Invitrogen #D6880-01;
TSTOM: Stomach (Tumor), Invitrogen #D6920-01;
BEAST: Adult breast, STARATAGENE #735044;
FEHRT: Fetal heart, STARATAGENE #738012;
FEKID: Fetal kidney, STARATAGENE #738014;
FELNG: Fetal lung, STARATAGENE #738020;
NOVAR: Adult ovary, STARATAGENE #735260;
BRASW: subtracted library (BRALZ-BRAWH). A cDNA library was constructed from mRNA prepared from tissues of cerebral cortex obtained from an Alzheimer patient [BRALZ: Cerebral cortex from an Alzheimer patient (Brain, cortex, Alzheimer), Invitrogen #D6830-01]; the cDNAs of this library whose nucleotide sequences were shared by those of mRNAs from whole brain tissue [BRAWH: Whole brain, CLONTECH #64020-1] were subtracted by using a Subtract Kit (Invitrogen #K4320-01).

Further, mRNAs extracted and purified as poly A(+) RNAs from the human tissues shown below were purchased. A cDNA library was prepared from an RNA mixture in which the poly A(+) RNA from each tissue had been combined with poly A(-) RNA. The poly A(-) RNA was prepared by removing poly A(+) RNA from the total RNA of whole brain tissue (CLONTECH #64020-1) by using oligo dT cellulose. The library names and the origins are indicated below in the order of "Library name: Origin".
<Purchase of mRNAs of Human Tissues as poly A(+) RNAs>
BRAMY: Brain (amygdala), CLONTECH #6574-1;
BRCAN: Brain (caudate nucleus), CLONTECH #6575-1;
BRCOC: Brain (corpus callosum), CLONTECH #6577-1;
BRHIP: Brain (hippocampus), CLONTECH #6578-1;
BRSSN: Brain (substantia nigra), CLONTECH #6580-1;
BRSTN: Brain (subthalamic nucleus), CLONTECH #6581-1;
BRTHA: Brain (thalamus), CLONTECH #6582-1.

(2) Preparation of cDNA Library cDNA library was prepared from each RNA by the improved method (WO 01/04286) of oligo capping [M. Maruyama and S. Sugano, Gene, 138: 171–174 (1994)]. A series of procedures, BAP (Bacterial Alkaline Phosphatase) treatment, TAP (Tobacco Acid Pyrophosphatase) treatment, RNA ligation, first strand cDNA synthesis and RNA removal, were carried out using the oligo-cap linker (SEQ ID NO: 4093) and oligo dT primer (SEQ ID NO: 4094), as described in WO 01/04286. Then, the single-stranded cDNA was converted to a double-stranded cDNA by PCR (polymerase chain reaction) using 5' (SEQ ID NO: 4095) and 3' (SEQ ID NO: 4096) PCR primers, and then digested with SfiI. Then, a fraction of cDNA fragments, typically 2-kb or longer (3-kb or longer in some cases), was unidirectionally cloned into a DraIII-digested pME18SFL3 vector (FIG. 1) (GenBank AB009864, Expression vector); the cDNA library was thus prepared.

The names of cDNA libraries, which were used in the analysis of full-length cDNA sequences, and their origins are shown in Table 2.

TABLE 2

| Library | Type | Origin, etc. |
|---|---|---|
| ADRGL | Tissue | Adrenal gland (CLONTECH #64016-1) |
| ASTRO | Primary culture cell | Normal Human Astrocyte NHA5732 (Takara Shuzo #CC2565) |
| BGGI1 | Culture cell | GI1 cells (RCB #RCB0763) |
| BNGH4 | Culture cell | H4 cells (ATCC #HTB-148) |
| BRACE | Tissue | Brain, cerebellum (CLONTECH #64035-1) |

TABLE 2-continued

| Library | Type | Origin, etc. |
|---|---|---|
| BRAMY | Tissue | Brain, amygdala (CLONTECH #6574-1 |
| BRAWH | Tissue | Brain, whole (CLONTECH #64020-1) |
| BRCAN | Tissue | Brain, caudate nucleus (CLONTECH #6575-1) |
| BRCOC | Tissue | Brain, *corpus callosum* (CLONTECH #6577-1) |
| BRHIP | Tissue | Brain. hippocampus (CLONTECH #6578-1) |
| BRSSN | Tissue | Brain, *substantia nigra* (CLONTECH #6580-1) |
| CD34C | Primary culture cell | CD34+ cells (AllCells, LLC #CB14435M) |
| CTONG | Tissue | Tongue, Cancer |
| DFNES | Primary culture cell | Normal Human Dermal Fibroblasts (Neonatal Skin); NHDF-Neo NHDF2564 (Takara Shuzo #CC2509) |
| FCBBF | Tissue | Brain, Fetal |
| FEBRA | Tissue | Brain, Fetal (CLONTECH #64019-1) |
| HCHON | Primary culture cell | Human Chondrocytes HC (Toyobo #T402K-05) |
| HEART | Tissue | Heart (CLONTECH #64025-1) |
| HHDPC | Primary culture cell | Human dermal papilla cells HDPC (Toyobo #THPCK-001) |
| HLUNG | Tissue | Lung (CLONTECH #64023-1) |
| KIDNE | Tissue | Kidney (CLONTECH #64030-1) |
| LIVER | Tissue | Liver (CLONTECH #64022-1) |
| MESAN | Primary culture cell | Normal human mesangial cells NHMC56046-2 (Takara Shuzo #CC2559) |
| NESOP | Tissue | Esophagus (Invitrogen #D6060-01) |
| NT2NE | Culture cell | NT2 cells concentrated after differentiation (NT2 Neuron) |
| NT2RI | Culture cell | NT2 cells treated by growth inhibitor for 2 weeks after RA induction for 5 weeks |
| NT2RP | Culture cell | NT2 cells treated by RA for 5 weeks |
| NTONG | Tissue | Tongue |
| OCBBF | Tissue | Brain, Fetal |
| PANCR | Tissue | Pancreas (CLONTECH #64031-1) |
| PEBLM | Primary culture cell | Human peripheral blood mononuclear cells HPBMC5939 (Takara Shuzo #CC2702) |
| PLACE | Tissue | Placenta |
| PROST | Tissue | Prostate (CLONTECH #64038-1) |
| PUAEN | Primary culture cell | Human pulmonary artery endothelial cells (Toyobo #T302K-05) |
| SALGL | Tissue | Salivary Gland (CLONTECH #64026-1) |
| SKMUS | Tissue | Skeletal Muscle (CLONTECH #64033-1) |
| SKNMC | Culture cell | SK-N-MC cells (ATCC #HTB-10) |
| SKNSH | Culture cell | SK-N-SH cells (RCB #RCB0426) |
| SMINT | Tissue | Small Intestine (CLONTECH #64039-1) |
| SPLEN | Tissue | Spleen (CLONTECH #64034-1) |
| TESOP | Tissue | Esophageal, Tumor (Invitrogen #D6860-01) |
| TESTI | Tissue | Testis (CLONTECH #64027-1) |
| THYMU | Tissue | Thymus (CLONTECH #64028-1) |
| TKIDN | Tissue | Kidney, Tumor (Invitrogen #D6870-01) |
| TRACH | Tissue | Trachea (CLONTECH #64091-1) |
| UMVEN | Primary culture cell | Human umbilical vein endothelial cells HUVEC (Toyobo #T200K-05) |
| UTERU | Tissue | Uterus (CLONTECH #64029-1) |

The cDNA library with the high fullness ratio (the fullness ratio of 5'-end, which was calculated for each cDNA library by using the protein coding region found in known mRNA species as an index, was 90% in average) prepared by the improved oligo-capping method was constructed by using a eukaryotic expression vector pME18SFL3. The vector contains SRα promoter and SV40 small t intron in the upstream of the cloning site, and SV40 polyA added signal sequence site in the downstream. As the cloning site of pME18SFL3 has asymmetrical DraIII sites, and the ends of cDNA fragments contain SfiI sites complementary to the DraIII sites, the cloned cDNA fragments can be inserted into the downstream of the SRα promoter unidirectionally. Therefore, clones containing full-length cDNA can be expressed transiently by introducing the obtained plasmid directly into COS cells, etc. Thus, the clones can be analyzed very easily in terms of the proteins that are the gene products of the clones, or in terms of the biological activities of the proteins.

(3) Assessment of the 5'-end Completeness of Clones Derived from the cDNA Library Prepared By Oligo-Capping With respect to the plasmid DNAs of clones derived from the libraries, the nucleotide sequences of cDNA 5'-ends (3'-ends as well in some cases) were determined in a DNA sequencer (ABI PRISM 3700, PE Biosystems), after sequencing reaction was conducted by using a DNA sequencing reagent (BigDye Terminator Cycle Sequencing FS Ready Reaction Kit, PE Biosystems) according to the manual. A database was constructed based on the obtained data.

The 5'-end completeness of about 770,000 clones derived from the human cDNA libraries prepared by the improved oligo-capping method was determined by the following method. The clones whose 5'-end sequences were consistent with those of known human mRNA in the public database were judged to be "full-length" if they had a longer 5'-end sequence than that of the known human mRNA; or even though the 5'-end sequence was shorter, if it contained the translation initiation codon it was judged to have the "full-length" sequence. Clones which did not contain the translation initiation codon were judged to be "not-full-length". The fullness ratio ((the number of full-length clones)/(the number of full-length and not-full-length clones)) at the 5'-end of the cDNA clones was determined by comparing with known human mRNA. As a result, the fullness ratio of the 5'-ends was 90%. The result indicates that the fullness ratio at the 5'-end sequence was extremely high in the human cDNA clones obtained by the oligo-capping method.

EXAMPLE 2

Sequencing Analysis of cDNA Ends and Selection of Full-Length Clones

With respect to the plasmid DNAs of clones obtained from each cDNA library, the 5'-end nucleotide sequences of the cDNAs were determined in a DNA sequencer (ABI PRISM 3700, PE Biosystems), after sequencing reaction was conducted by using a DNA sequencing reagent (Dye Terminator Cycle Sequencing FS Ready Reaction Kit, dRhodamine Terminator Cycle Sequencing FS Ready Reaction Kit or BigDye Terminator Cycle Sequencing FS Ready Reaction Kit, PE Biosystems) according to the manual. A database was constructed using the data obtained.

For the analyzed 5'-end sequences of cDNA clones, the data with the annotation of "complete cds " in the GenBank and UniGene were searched by BLAST homology search. When identical to certain human mRNA sequences, such cDNA clones were excluded. Then, clustering was carried out. When the identity was 90% or higher, and the length of consensus sequence was 50 base pairs or longer, the cDNA clones were assumed to belong to an identical cluster, and thus clustered. cDNA clones longer in the 5' direction were selected from the members belonging to a cluster; if required, the 3'-end sequences of the selected clones were determined by the same analysis method as used to determine the 5'-end sequences. The data of the end sequences obtained were analyzed, and then the clones forming a sequence contig at 5'- and 3'-ends were excluded. Further, as mentioned above, the data was analyzed again by BLAST homology search; when identical to certain human mRNA sequences (including sequences patented and applied for), the cDNA clones were excluded. Thus, the cDNAs clones to be analyzed for their nucleotide sequence were obtained.

EXAMPLE 3

Analysis of the Full-Length Nucleotide Sequences

The full-length nucleotide sequences of the selected clones were determined. The nucleotide sequence determination was mainly performed by primer walking method comprising the dideoxy terminator method using custom-made synthetic DNA primers. Namely, the nucleotide sequences of the DNAs were determined in a sequencer from PE Biosystems, after sequencing reaction was carried out with a DNA sequencing reagent from the same supplier using the custom-made synthetic DNA primers according to the manual. A part of the clones were analyzed with a DNA sequencer from Licor.

Further, the nucleotide sequences of a part of the clones were determined by the shotgun method where the plasmids containing the cDNAs were digested at random were used, instead of the use of custom-made primers, by the same method in the DNA sequencer. The full-length nucleotide sequences were finally determined by completely assembling the partial nucleotide sequences obtained by the above method.

Then, the regions translatable to proteins were deduced from the determined full-length nucleotide sequences, and thereby the amino acid sequences were determined. SEQ ID NOs corresponding to the respective sequences are shown in Table 1.

EXAMPLE 4

Functional Prediction by Homology Search

For the determined nucleotide sequences, GenBank, SwissProt, UniGene, and nr were searched by BLAST. The clones exhibiting higher homology, which were convenient to predict their functions based on the nucleotide sequences and deduced amino acid sequences, were selected based on the BLAST search hit data whose P value or E value was $10^{-4}$ or lower and for which the length of consensus sequence×homology=30 or higher in the amino acid database search. Further, from them, representative clones were selected, which are shown as Homology Search Result Data in the last part herein. Accordingly, the data shown herein are merely the representative data, and the molecule exhibiting homology to each clone is not limited thereto. Further, with respect to a part of clones, the BLAST search hit data that did not meet the criteria as described above are not shown herein.

EXAMPLE 5

Search for Signal Sequence, Transmembrane Domain and other Functional Domains in the Deduced Amino Acid Sequences With respect to the amino acid sequences deduced from the full-length nucleotide sequences, the prediction was made for the presence of signal sequence at the amino terminus, the presence of transmembrane domain, and the presence of functional protein domains (motifs). The signal sequence at the amino terminus was searched for by PSORT [K. Nakai & M. Kanehisa, Genomics, 14:897–911(1992)]; the transmembrane domain, by SOSUI [T. Hirokawa et al., Bioinformatics, 14: 378–379 (1998)] (Mitsui Knowledge Industry); the function domain, by Pfam.

The amino acid sequence in which the signal sequence at the amino terminus or transmembrane domain had been predicted to be present by PSORT or SOSUI were assumed to be a secretory or membrane protein. Further, when the amino acid sequence hit a certain functional domain by the Pfam functional domain search, the protein function can be predicted based on the hit data, for example, by referring to the function categories on the PROSITE. In addition, the functional domain search can also be carried out on the PROSITE.

The search results obtained with the respective programs are shown below.

The clones whose deduced amino acid sequences were detected to have the signal sequences by PSORT are as follows.

---

ADRGL20021910, ADRGL20036380,
ADRGL20063770, ASTRO20020240,
BNGH420052350, BNGH420077980,
BRACE20054080, BRACE20194670,
BRAMY20044920, BRAMY20047560,
BRAMY20137360, BRAMY20204270,
BRAMY20237190, BRAMY20251750,
BRAWH20020470, BRAWH20093070,
BRCAN10001680, BRHIP10000720,
BRSSN20091190, CD34C20001750,
CTONG20059130, CTONG20069320,
FCBBF30062490, FCBBF30132660,
FEBRA20039260, FEBRA20040230,
FEBRA20040560, FEBRA20046280,
FEBRA20182030, HCHON10001660,
HCHON20015050, HEART10001490,
HHDPC20088160, HLUNG20032460,
HLUNG20034970, HLUNG20050760,
HLUNG20081390, HLUNG20088750,
KIDNE20134130, KIDNE20143200,
LIVER20007750, LIVER20010510,
MESAN20021220, MESAN20027900,
MESAN20095220, NT2NE20069580,
NT2NE20082130, NT2NE20167660,
NT2RP70003110, OCBBF20000740,
OCBBF20012520, OCBBF20110730,
OCBBF20118720, OCBBF20155030,
OCBBF20170350, OCBBF20191950,
PANCR10000860, PEBLM20001800,
PLACE60004260, PLACE60006300,
PLACE60055590, PLACE60056910,
PLACE60057860, PLACE60104630,
PLACE60184870, PROST20050390,
PROST20084680, PROST20105450,
PROST20106060, PROST20110120,
SKMUS20091900, SKNMC20006350,
SMINT20024140, SMINT20028840,
SMINT20086250, SMINT20088440,
SMINT20088690, SPLEN20017810,
SPLEN20073880, SPLEN20080070,
SPLEN20101950, SPLEN20108000,
SPLEN20110860, SPLEN20118050,
SFLEN20138600, SPLEN20139100,
SPLEN20193230, SPLEN20193490,
SPLEN20201830, TESTI20043130,
TESTI20047370, TESTI20057200,
TESTI20059080, TESTI20061200,
TESTI20063330, TESTI20063600,
TESTI20102390, TESTI20116120,
TESTI20151800, TESTI20166670,
TESTI20210030, TEST120245860,
THYMU20020800, THYMU20046770,
THYMU20050010, THYMU20054800,

-continued

THYMU20055740, THYMU20083390,
THYMU20115380, TRACH20081270,
TRACH20159390, UTERU20040150,
UTERU20064120, UTERU20086530,
UTERU20127150

The clones whose deduced amino acid sequences were detected to have the transmembrane domains by SOSUI are as follows. Numerals indicate the numbers of transmembrane domains detected in the deduced amino acid sequences. Of the search result, the clone name and the number of transmembrane domains are demarcated by a double slash mark (//).

ADRGL20020290//10, ADRGL20021910//2, ADRGL20063770//2,
ASTRO20010010//4, ASTRO20045840//3, ASTRO20053430//1,
ASTRO20055530//1, ASTRO20055570//2, ASTRO20055930//2,
ASTRO20075150//1, ASTRO20088950//1, ASTRO20091180//4,
BNGH420021680//1, BNGH420023870//1, BNGH420052350//1,
BNGH420059680//1, BNGH420075940//1, BNGH420087430//3,
BRACE10000510//2, BRACE20052530//1,
BRACE20066360//3, BRACE20068710//1, BRACE20069000//5,
BRACE20069110//1, BRAMY10001730//1, BRAMY20001510//1,
BRAMY20003880//1, BRAMY20024790//2, BRAMY20027390//2,
BRAMY20028530//2, BRAMY20035380//2, BRAMY20045210//1,
BRAMY20050940//3, BRAMY20053910//2, BRAMY20055760//5,
BRAMY20072440//8, BRAMY20083820//2, BRAMY20089770//1,
BRAMY20096930//1, BRAMY20118410//1,
BRAMY20123400//2, BRAMY20125550//1, BRAMY20127310//1,
BRAMY20127760//1, BRAMY20135720//3, BRAMY20139440//5,
BRAMY20152510//1, BRAMY20194680//2, BRAMY20204270//1,
BRAMY20225320//2, BRAMY20237190//1, BRAMY20251750//1,
BRAMY20285650//2, BRAWH20020470//7, BRAWH20026010//1,
BRAWH20030000//2, BRAWH20039640//2, BRAWH20055330//1,
BRAWH20078620//2, BRAWH20093040//3,
BRAWH20185270//5, BRAWH20190550//1, BRCAN10000760//10,
BRCAN20001480//3, BRCAN20004180//1, BRCOC20000470//2,
BRCOC20003600//1, BRHIP10001040//5, BRHIP20000210//1,
BRSSN20001970//4, BRSSN20074640//2, CD34C20001750//1,
CTONG20017490//1, CTONG20029030//4, CTONG20041260//9,
CTONG20044870//2, CTONG20045500//2, CTONG20049480//3,
CTONG20051450//1, CTONG20056150//2,
CTONG20059130//6, CTONG20060040//1, CTONG20065680//1,
CTONG20071680//13, CTONG20076810//1, CTONG20078340//2,
CTONG20079590//1, CTONG20083980//1, CTONG20084020//2,
CTONG20167750//1, CTONG20168240//3, CTONG20179890//5,
CTONG20183830//1, DFNES20018000//2, DFNES20028170//1,
DFNES20029660//8, DFNES20072990//9, DFNES20080880//1,
FCBBF20018680//3, FCBBF20029280//2,
FCBBF20032930//1, FCBBF20036360//2, FCBBF20054390//2,
FCBBF30022680//1, FCBBF30042610//7, FCBBF30062490//2,
FCBBF30075970//1, FCBBF30078600//3, FC3BF30095410//1,
FCBBF30105440//3, FCBBF30118670//1, FCBBF30145670//1,
FCBBF30164510//1, FCBBF30169870//1, FCBBF30172330//1,
FCBBF30177290//2, FCBBF30179740//1, FCBBF30195690//2,
FCBBF30197840//1, FCBBF30212210//1,
FCBBF30223110//1, FCBBF30225930//9, FCBBF30230610//1,
FCBBF30260480//5, FCBBF30266510//3, FCBBF30287940//1,
FCBBF50000610//2, FCBBF50004950//3, FEBRA20007820//4,
FEBRA20018670//2, FEBRA20031280//7, FEBRA20031810//2,
FEBRA20040560//4, FEBRA20057010//1, FEBRA20080860//1,
FEBRA20084750//1, FEBRA20115930//10, FEBRA20116650//4,
FEBRA20121950//5, FEBRA20141980//1,
FEBRA20177800//1, FEBRA20182030//1, HCHON20015050//1,
HEART20031680//1, HHDPC10001140//1, HHDPC20051850//1,
HHDPC20082790//3, HHDPC20088160//1, HLUNG20015070//2,
HLUNG20020850//2, HLUNG20029490//1, HLUNG20032460//1,
HLUNG20033350//1, HLUNG20037160//2, HLUNG20050760//1,
HLUNG20052300//1, HLUNG20060670//1, HLUNG20065990//1,
HLUNG20074330//1, HLUNG20081390//2,
HLUNG20092530//1, KIDNE20016360//5, KIDNE20083150//3,
KIDNE20084030//12, KIDNE20084800//2, KIDNE20086490//1,

-continued

KIDNE20086660//2, KIDNE20094670//1, KIDNE20142900//1,
KIDNE20148080//1, KIDNE20160960//2, KIDNE20163710//1,
KIDNE20169180//2, KIDNE20182540//3, KIDNE20186170//1,
KIDNE20188630//1, KIDNE20189960//1, LIVER20007750//8,
LIVER20010990//4, LIVER20030650//6,
LIVER20038000//4, MESAN20007110//1, MESAN20008150//3,
MESAN20021220//2, MESAN20060430//1, MESAN20067430//3,
MESAN20084150//3, NT2NE20018740//1, NT2NE20039210//1,
NT2NE20053230//1, NT2NE20059210//1, NT2NE20080770//1,
NT2NE20082130//3, NT2NE20092950//1, NT2NE20152620//1,
NT2NE20167660//1, NT2NE20181800//1, NT2RI20016240//2,
NT2RI20021200//3, NT2RI20033920//5,
NT2RP70027790//2, NT2RP70031070//10, NT2RP70031480//6,
NT2RP70087140//1, OCBBF20000740//2, OCBBF20012520//2,
OCBBF20109780//1, OCBBF20110210//2, OCBBF20110730//2,
OCBBF20112280//3, OCBBF20118720//3, OCBBF20123200//2,
OCBBF20165910//9, OCBBF20176650//1, OCBBF20185630//1,
OCBBF20191950//3, PANCR10000860//1, PLACE60004260//1,
PLACE60006300//2, PLACE60053280//3,
PLACE60056910//1, PLACE60057860//3, PLACE60061370//1,
PLACE60070500//2, PLACE60104630//3, PLACE60107010//2,
PLACE60184870//1, PROST20011160//2, PROST20014150//2,
PROST20035830//1, PROST20050390//1, PROST20065100//7,
PROST20073280//1, PROST20082430//1, PROST20084680//3,
PROST20105450//6, PROST20110120//1, PROST20114100//2,
PROST20152510//4, PROST20168600//6,
PUAEN10000870//2, SKMUS20006790//1, SKMUS20020770//1,
SKNMC20006350//1, SKNSH20094350//2, SMINT20008110//3,
SMINT200241401/1, SMINT20026200//1, SMINT200288401/1,
SMINT20045470//1, SMINT20081330//2, SMINT20092160//1,
SPLEN20015100//2, SPLEN20017610//1, SPLEN20017810//2,
SPLEN20024620//2, SPLEN20054500//1, SPLEN20058180//1,
SPLEN20090880//2,
SPLEN20101950//5, SPLEN20104690//1, SPLEN20105100//2,
SPLEN20110180//1, SPLEN20121790//1, SPLEN20125230//1,
SPLEN20136700//1, SPLEN20175920//1, SPLEN20177400//2,
SPLEN20182850//1, SPLEN20183950//1, SPLEN20190080//1,
SPLEN20190770//1, SPLEN20193230//1, SPLEN20193790//1,
SPLEN20204670//1, TESOP10000350//1, TESTI20006160//5,
TEST120038240//1, TEST1200432201/1,
TEST120046540//1, TEST120046870//1, TESTI20050400//1,
TEST120051730//7, TEST120053260//2, TEST120053780//1,
TEST120057200//1, TEST120057590//1, TESTI20061200//10,
TEST120062120//1, TEST120063330//1, TEST120063410//1,
TEST120068530//2, TEST120070400//10, TEST120070740//1,
TESTI20073460//1, TESTI20095200//6, TESTI20095880//10,
TESTI20100090//1, TESTI20102390//2,
TESTI20113940//3, TESTI20121040//1, TESTI20149880//3,
TESTI20151800//3, TESTI20162780//4, TESTI20170170//1,
TESTI20173050//1, TESTI20186110//1, TESTI20198540//2,
TESTI20199110//1, TESTI20202830//1, TESTI20204260//1,
TESTI20214630//2, TESTI20244730//1, TESTI20245860//1,
TESTI20246410//1, TESTI20257910//1, TESTI20260640//1,
TESTI20261040//4, TESTI20262510//1,
TESTI20262940//1, TESTI20264910//1, TESTI20271790//9,
TESTI20278280//3, TESTI20282420//2, TESTI20282900//1,
TESTI20286590//1, THYMU20007020//3, THYMU20012020//1,
THYMU20017270//2, THYMU20020800//4, THYMU20025480//3,
THYMU20030690//7, THYMU20034790//2, THYMU20046350//1,
THYMU20050010//5, THYMU20054800//2, THYMU20055740//1,
THYMU20062770//1, THYMU20078240//1,
THYMU20079690//2, THYMU20083390//3, THYMU20087270//1,
THYMU20100940//4, THYMU20106990//1, THYMU20115380//2,
THYMU20137050//3, THYMU20137570//1, THYMU20143230//2,
THYMU20145990//3, THYMU20150190//2, THYMU20153210//10,
THYMU20154790//3, THYMU20163600//2, THYMU20171580//1,
THYMU20176010//1, THYMU20178440//1, THYMU20185470//2,
TRACH20011540//2, TRACH20021380//4,
TRACH20073990//1, TRACH20081270//2, TRACH20149720//1,
TRACH20149740//1, TRACH20163470//11, TRACH20165330//3,
TRACH20167090//2, TRACH20173680//8, UMVEN10001380//2,
UTERU20035770//1, UTERU20045200//5, UTERU20064120//7,
UTERU20086530//2, UTERU20089300//1, UTERU20095100//3,
UTERU20099040//5, UTERU20103200//3, UTERU20125810//1,
UTERU20127150//8, UTERU20139760//1,
UTERU20188840//2

The Names of clones whose deduced amino acid sequences were detected to have functional domains with Pfam, and the name of hit functional domains are as follows. The search result is indicated as "clone name//functional domain name". When the clone has multiple hit functional domains, they are listed and demarcated by a double slash mark (//). When the clone has multiple hits of an identical functional domain, each is listed without abridgment.

ADRGL20020290//Sodium:galactoside symporter family//Nucleoside transporter
ADRGL20021910//Immunoglobulin domain
ADRGL20026790//PWWP domain
ADRGL20036840//Class I Histocompatibility antigen, domains alpha 1 and 2
ADRGL20047770//ATP synthase (F/14-kDa) subunit
ADRGL20059610//O-Glycosyl hydrolase family 30
ADRGL20062330//Spectrin repeat//Spectrin repeat//Bacterial flagellin N-terminus//Spectrin repeat//Spectrin repeat//Spectrin repeat
ADRGL20066770//Collagen triple helix repeat (20 copies)//C1q domain
ADRGL20079060//Transglutaminase-like superfamily
ASTRO20006530//Intermediate filament proteins//Myc leucine zipper domain
ASTRO20010010//Photosynthetic reaction center protein
ASTRO20010290//PHD-finger
ASTRO20026320//Viral (Superfamily 1) RNA helicase//Heavy-metal-associated domain//Viral (Superfamily-1) RNA helicase
ASTRO20038400//Homeobox domain//Common central domain of tyrosinase//Rhabdovirus nucleocapsid protein//Homeobox domain//Homeobox domain//Homeobox domain
ASTRO20046280//MutT-like domain
ASTRO20050810//FGGY family of carbohydrate kinases//FGGY family of carbohydrate kinases
ASTRO20052420//RhoGEF domain//PH domain//SH3 domain
ASTRO20053430//FERM domain (Band 4.1 family)//FERM domain (Band 4.1 family)//Delta-aminolevulinic acid dehydratase//Lipoprotein amino terminal region
ASTRO20055570//Prion protein
ASTRO20055930//Aldehyde oxidase and xanthine dehydrogenase, C terminus//Zinc finger, C3HC4 type (RING finger)
ASTRO20085080//WD domain, G-beta repeat//Fibrillarin//WD domain, G-beta repeat//WD domain, G-beta repeat//WD domain, G-beta repeat//WD domain, G-beta repeat//WD domain, G-beta repeat
ASTRO20088950//Glycosyl hydrolase family 1
BGGI120010750//Phosphoglucose isomerase//Ribosomal protein L7Ae
BNGH420015760//WD domain, G-beta repeat//WD domain, G-beta repeat//WD domain, G-beta repeat//WD domain, G-beta repeat//WD domain, G-beta repeat
BNGH420024870//C2 domain//C2 domain//C2 domain
BNGH420035290//Zinc finger, C3HC4 type (RING finger)//TRAF-type zinc finger//Hr1 repeat motif//WD domain, G-beta repeat//WD domain, G-beta repeat//WD domain, G-beta repeat//WD domain, G-beta repeat//WD domain, G-beta repeat//WD domain, G-beta repeat
BNGH420036410//Arsenical pump membrane protein
BNGH420046790//Immunoglobulin domain
BNGH420052350//Urotensin II
BNGH420059680//NHL repeat//NHL repeat//NHL repeat//NHL repeat
BNGH420070370//Zinc finger, C2H2 type//Zinc finger, C2H2 type//Zinc finger, C2H2 type//Zinc finger, C2H2 type//Zinc finger, C2H2 type
BNGH420074600//RNA polymerase beta subunit
BNGH420077980//Immunoglobulin domain//Immunoglobulin domain//Immunoglobulin domain//Immunoglobulin domain//Immunoglobulin domain//Immunoglobulin domain
BNGH420086030//PH domain//RhoGAP domain
BRACE20003310//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
BRACE20007330//BTB/POZ domain//Kelch motif//Kelch motif//Kelch motif//Kelch motif//Kelch motif//Kelch motif
BRACE20014450//alpha/beta hydrolase fold
BRACE20050870//DEAD/DEAH box helicase
BRACE20051600//Reverse transcriptase (RNA-dependent DNA polymerase)
BRACE20051930//MAM domain.
BRACE20054600//von Willebrand factor type D domain
BRACE20055560//WD domain, G-beta repeat//WD domain, G-beta repeat
BRACE20059810//TSC-22/dip/bun family
BRACE20061620//SPRY domain
BRACE20065470//Ubiquitin family
BRACE20069000//CLN3 protein
BRACE20079200//von Willebrand factor type D domain
BRACE20099070//FYVE zinc finger
BRACE20196180//HMG (high mobility group) box
BRACE20204670//Protein-tyrosine phosphatase//Dual specificity phosphatase, catalytic domain//Fatty acid desaturase//Protein-tyrosine phosphatase
BRACE20215410//Imidazoleglycerol-phosphate dehydratase//UvrD/REP helicase
BRAMY20001510//Zinc finger, C3HC4 type (RING finger)//PHD-finger
BRAMY20003540//PH domain//EF hand//EF hand//Viral RNA dependent RNA polymerase//Phosphatidylinositol-specific phospholipase C, X domain//Phosphatidylinositol-specific phospholipase C, Y domain//Bleomycin resistance protein//C2 domain
BRAMY20005080//Ubiquitin carboxyl-terminal hydrolase family 2
BRAMY20013670//S-adenosylmethionine synthetase
BRAMY20016780//Proprotein convertase P-domain
BRAMY20023640//UBX domain
BRAMY20027990//C2 domain
BRAMY20028620//Quinolinate phosphoribosyl transferase
BRAMY20035380//Cation efflux family
BRAMY20035830//BTB/POZ domain//Thymidylate synthase
BRAMY20038980//Granulocyte-macrophage colony-stimulating factor//Borrelia outer surface protein E and F
BRAMY20040580//Zinc finger, C2H2 type//Zinc finger, C2H2 type
BRAMY20043630//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat
BRAMY20044920//Ubiquitin carboxyl-terminal hydrolase family 2

BRAMY20045420//Domain found in Dishevelled, Eg1-10, and Pleckstrin
BRAMY20051820//C2 domain
BRAMY20056620//Carboxyl transferase domain
BRAMY20056840//PWWP domain
BRAMY20076100//Ligand-binding domain of nuclear hormone receptor
BRAMY20089770//ATP P2X receptor
BRAMY20091230//Mitochondrial carrier proteins//Mitochondrial carrier proteins
BRAMY20094890//SURF4 family
BRAMY20102900//Ephrin
BRAMY20111780//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C3HC4 type (RING finger)//Zinc finger, C2H2 type//Zinc finger, C2H2 type
BRAMY20117670//DnaJ central domain (4 repeats)//DnaJ C terminal region
BRAMY20118410//Phospholipase D. Active site motif
BRAMY20118490//FGGY family of carbohydrate kinases
BRAMY20125360//Asparaginase
BRAMY20134050//Nucleosome assembly protein (NAP)
BRAMY20143870//Peptidyl-tRNA hydrolase
BRAMY20152510//Protein-tyrosine phosphatase//Dual specificity phosphatase, catalytic domain
BRAMY20158550//EF hand//EF hand
BRAMY20206340//WD domain, G-beta repeat//Dockerin domain type I//WD domain, G-beta repeat//WD domain, G-beta repeat//WD domain, G-beta repeat//WD domain, G-beta repeat
BRAMY20227860//Insulin-like growth factor binding proteins//Spectrin repeat
BRAMY20234820//Ribosomal L25p family
BRAMY20238630//TPR Domain//TPR Domain//TPR Domain
BRAMY20244490//Adenylate kinase
BRAMY20245140//Cyclic nucleotide-binding domain
BRAMY20251210//Ephrin receptor ligand binding domain//EB module
BRAMY20263000//WD domain, G-beta repeat//WD domain, G-beta repeat//WD domain, G-beta repeat//WD domain, G-beta repeat//WD domain, G-beta repeat//WD domain, G-beta repeat
BRAMY20274510//Ribosomal protein L11
BRAWH20014590//RNA recognition motif. (a.k.a. RRM, RBD, or RNP domain)
BRAWH20021910//Carboxylesterases
BRAWH20026010//Hepatitis C virus RNA dependent RNA polymerase
BRAWH20039640//Leucine rich repeat N-terminal domain//Leucine Rich Repeat//Leucine Rich Repeat//Leucine Rich Repeat//Leucine Rich Repeat//Leucine Rich Repeat//Leucine rich repeat C-terminal domain//Leucine rich repeat N-terminal domain//Leucine Rich Repeat//Leucine Rich Repeat//Leucine Rich Repeat//Leucine Rich Repeat//Leucine Rich Repeat//Leucine rich repeat C-terminal domain
BRAWH20040680//Zinc finger, C3HC4 type (RING finger)//DENN (AEX-3) domain
BRAWH20047790//HMG (high mobility group) box
BRAWH20050740//BTB/POZ domain
BRAWH20080580//Zinc finger, C2H2 type//Zinc finger, C2H2 type//Zinc finger, C2H2 type//Zinc finger, C2H2 type//DnaJ central domain (4 repeats)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
BRAWH20093040//Eukaryotic protein kinase domain
BRAWH20094900//BNR repeat//BNR repeat//BNR repeat
BRAWH20095900//KRAB box//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type
BRAWH20183170//Leucine Rich Repeat//Leucine Rich Repeat//Leucine Rich Repeat//Leucine Rich Repeat
BRAWH20185260//Troponin//Serine hydroxymethyltransferase
BRAWH20185270//Uncharacterized protein family UPF0057
BRAWH20188750//Glypican//ubiE/COQ5 methyltransferase family
BRAWH20191980//Proline dehydrogenase
BRCAN10001050//Cell division protein
BRCAN20005410//Zinc finger, C4 type (two domains)//Zinc finger, C2HC type//SAM domain (Sterile alpha motif)//Sterile alpha motif (SAM)/Pointed domain
BRCOC20000470//TPR Domain//TPR Domain
BRSSN20005610//PDZ domain (Also known as DHR or GLGF).
BRSSN20005660//Bacterial type II secretion system protein
BRSSN20066440//SCAN domain//Zinc finger, C2H2 type//Zinc finger, C2H2 type//Zinc finger, C2H2 type
BRSSN20074640//Peptidase family M48
BRSSN20093890//Kelch motif//Kelch motif
CD34C20001750//Immunoglobulin domain//Immunoglobulin domain
CTONG20004110//Ank repeat//Ank repeat//Ank repeat//Ank repeat//Ank repeat//Tropomyosins//Transient receptor//Apolipoprotein A1/A4/E family//MutS family, N-terminal putative DNA binding domain//K-box region//Outer membrane efflux protein
CTONG20004520//SH3 domain
CTONG20007660//Caspase recruitment domain//DNA polymerase (viral) N-terminal domain//bZIP transcription factor//K-box region
CTONG20008190//ADP-ribosylation factor family//Ras family
CTONG20017490//Sema domain//Sema domain//Integrins, beta chain//Plexin repeat
CTONG20020950//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
CTONG20029030//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat
CTONG20030280//WD domain, G-beta repeat//Gram-negative pili assembly chaperone//WD domain, G-beta repeat//WD domain, G-beta repeat//WD domain, G-beta repeat//WD domain, G-beta repeat//WD domain, G-beta repeat
CTONG20032930//Armadillo/beta-catenin-like repeats
CTONG20033610//RyR domain CTONG20033750//FtsK/SpoIIIE family//ATPases associated with various cellular activities (AAA)
CTONG20036990//Immunoglobulin domain//Immunoglobulin domain
CTONG20044230//Zinc finger, C2H2 type//Zinc finger, C2H2 type
CTONG20044870//PH domain//PH domain
CTONG20045500//Translation initiation factor IF-3//HCO3-transporter family//HCO3-transporter family//Domain of unknown function DUF139
CTONG20046690//Src homology domain 2
CTONG20049480//bZIP transcription factor//Carbamoyl-phosphate synthase (CPSase)//tRNA synthetases class I (C)
CTONG20060040//NusB family
CTONG20063770//KE2 family protein//Spectrin repeat
CTONG20063930//SH3 domain//WW domain//WW domain//PH domain//RhoGAP domain
CTONG20066110//TPR Domain//TPR Domain
CTONG20068360//Mitochondrial carrier proteins//Mitochondrial carrier proteins
CTONG20069420//Ribosomal protein S14p/S29e
CTONG20070090//*Bacterial luciferase*
CTONG20070720//PH domain//RhoGAP domain//bZIP transcription factor
CTONG20070910//PCI domain
CTONG20071040//Beta/Gamma crystallin//Beta/Gamma crystallin//Beta/Gamma crystallin//Beta/Gamma crystallin//Similarity to lectin domain of ricin beta-chain, 3 copies.
CTONG20071680//3'–5' exonuclease//Cytochrome c oxidase subunit III//Ammonium Transporter Family//7 transmembrane receptor (Secretin family)
CTONG20072930//KRAB box//Ribosomal protein L20//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Putative zinc finger in N-recognin//Zinc finger, C2H2 type//Zinc finger, C2H2 type//Zinc finger, C2H2 type//Zinc finger, C2H2 type//Zinc finger, C2H2 type
CTONG20074000//Zinc finger, C2H2 type//Zinc finger, C2H2 type//Zinc finger, C2H2 type//Zinc finger, C2H2 type//Zinc finger, C2H2 type
CTONG20074170//DENN (AEX-3) domain
CTONG20076810//Ribosomal protein L16//Pheromone A receptor
CTONG20079590//Sialyltransferase family
CTONG20083430//Nuclear transition protein 2
CTONG20083980//WH1 domain
CTONG20084660//SCAN domain
CTONG20085210//Lipase (class 3)
CTONG20165750//G-patch domain//Double-stranded RNA binding motif
CTONG20169040//bZIP transcription factor//Adenylate cyclase//Intermediate filament proteins
CTONG20170940//Ank repeat//Ank repeat//Ank repeat//SAM domain (Sterile alpha motif)
CTONG20174580//TBC domain
CTONG20176040//ADP-ribosylation factor family//Ras family
CTONG20180690//Collagen triple helix repeat (20 copies)
CTONG20183430//Ank repeat//Ank repeat//Ank repeat//Ank repeat//Ank repeat//Ank repeat//Ank repeat//Zinc finger, C3HC4 type (RING finger)//Zinc finger, C3HC4 type (RING finger)//Zinc finger, C3HC4 type (RING finger)
CTONG20184830//ABC transporter
CTONG20186290//Aldehyde dehydrogenase family
CTONG20186370//KRAB box//Zinc finger, C2H2 type//Zinc finger, C2H2 type//Zinc finger, C2H2 type//Zinc finger, C2H2 type
CTONG20186520//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type
CTONG20186550//BTB/POZ domain//K+ channel tetramerisation domain
CTONG20188080//TPR Domain
CTONG20189000//RhoGEF domain
CTONG20190290//R3H domain//RNA dependent RNA polymerase//Uncharacterized protein family UPF0024
DFNES20025500//Sigma-54 interaction domain//ATPases associated with various cellular activities (AAA)
DFNES20043710//Src homology domain 2//Domain of unknown function DUF36
DFNES20055400//Viral coat protein//Putative diphthamide synthesis protein//Influenza non-structural protein (NS1)
DFNES20057660//Plant thionins//Mitochondrial carrier proteins//Mitochondrial carrier proteins
DFNES20072990//Integral membrane protein DUF6//Integral membrane protein DUF6
DFNES20073320//Zinc finger, C3HC4 type, (RING finger)//PHD-finger//B-box zinc finger.
DFNES20076340//Zinc finger, C2H2 type//Zinc finger, C2H2 type//Zinc finger, C2H2 type
DFNES20080880//Glycosyl transferases//Similarity to lectin domain of ricin beta-chain, 3 copies.
DFNES20094820//PHD-finger//Zn-finger in ubiquitin-hydrolases and other proteins
FCBBF10000230//Sec7 domain//PH domain
FCBBF10004760//HMG (high mobility group) box
FCBBF20018680//C2 domain//C2 domain
FCBBF20020440//Urease
FCBBF20023490//Helicases conserved C-terminal domain
FCBBF20033360//BTB/POZ domain//Kelch motif//Kelch motif//Kelch motif//Kelch motif//Kelch motif
FCBBF20035430//AN1-like Zinc finger//AN1-like Zinc finger
FCBBF20035490//KH domain
FCBBF20041380//SAM domain (Sterile alpha motif)
FCBBF20043730//UBA domain
FCBBF20059660//TPR Domain
FCBBF20066340//PH domain
FCBBF20070950//DNA binding domain with preference for A/T rich regions
FCBBF30001100//DENN (AEX-3) domain//PPR repeat
FCBBF30002270//linker histone H1 and H5 family
FCBBF30003610//Zinc finger, C2H2 type//Zinc finger, C2H2 type//Zinc finger, C2H2 type//Plant PEC family metallothionein//DM DNA binding domain//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type//Phorbol esters/diacylglycerol binding domain (C1 domain)
FCBBF30004340//Ribosomal protein S3, C-terminal domain.//Similarity to lectin domain of ricin beta-chain, 3 copies.

FCBBF30005360//Sigma-54 interaction domain//ATPases associated with various cellular activities (AAA)//ATPases associated with various cellular activities (AAA)

FCBBF30005500//PH domain//PH domain//Putative GTPase activating protein for Arf

FCBBF30019140//'chromo' (CHRromatin Organization MOdifier) domain//'chromo' (CHRromatin Organization MOdifier) domain//DEAD/DEAH box helicase//SNF2 and others N-terminal domain//Helicases conserved C-terminal domain FCBBF30019180//Armadillo/beta-catenin-like repeats//Lipoprotein amino terminal region FCBBF30021900//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//BolA-like protein//Zinc finger, C2H2 type//Zinc finger, C2H2 type//Snake toxin//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type FCBBF30022680//3'–5' exonuclease FCBBF30029250//SET domain FCBBF30035570//C2 domain FCBBF30048420//T-box//wnt family of developmental signaling proteins FCBBF30071500//Influenza RNA-dependent RNA polymerase subunit PB1//Reprolysin family propeptide//Leptin FCBBF30076310//Eukaryotic protein kinase domain//Eukaryotic protein kinase domain//Protein kinase C terminal domain FCBBF30079770//D-isomer specific 2-hydroxyacid dehydrogenases FCBBF30080730//RNA recognition motif. (a.k.a. RRM, RBD, or RNP domain)//Zinc knuckle FCBBF30085560//Pyridine nucleotide-disulphide oxidoreductase//FAD binding domain//Flavin containing amine oxidase//Phytoene dehydrogenase related enzyme FCBBF30093170//Zinc finger, C2H2 type//Zinc finger, C2H2 type//Zinc finger, C2H2 type//Zinc finger, C2H2-type//Zinc finger, C2H2 type FCBBF30100080//Sec7 domain FCBBF30100120//PDZ domain (Also known as DHR or GLGF).

FCBBF30100410//Nucleosome assembly protein (NAP)

FCBBF30118670//Reprolysin (M12B) family zinc metalloprotease//Disintegrin//EB module//Hantavirus glycoprotein G2//Adenovirus E3 region protein CR2//jmjN domain FCBBF30125460//Zinc finger, C3HC4 type (RING finger)

FCBBF30129010//KRAB box//Zinc finger, C2H2 type//GATA zinc finger//Zinc finger, C2H2 type//Zinc finger, C2H2 type//Zinc finger, C2H2 type//Zinc finger, C2H2 type//Transcription factor S-II (TFIIS)//Zinc finger, C2H2 type FCBBF30130410//UvrB/uvrC motif FCBBF30132060//Galactosyltransferase//Fringe-like FCBBF30132660//Leucine rich repeat N-terminal domain//Leucine Rich Repeat//Leucine Rich Repeat//Leucine Rich Repeat//Leucine Rich Repeat//Leucine Rich Repeat//Leucine Rich Repeat//Leucine Rich Repeat FCBBF30136230//Zinc finger, C2H2 type//Zinc finger, C2H2 type//Zinc finger, C2H2 type//Zinc finger, C2H2 type//Cystatin domain//Homeobox domain//Zinc finger, C2H2 type//Zinc finger, C2H2 type//Zinc finger, C2H2 type FCBBF30142290//PHD-finger FCBBF30143550//Phosphatidylinositol-4-phosphate 5-Kinase FCBBF30153170//Phosphofructokinase//Phosphofructokinase//Phosphofructokinase//Phosphofructokinase FCBBF30161780//gag gene protein p24 (core nucleocapsid protein)//Zinc knuckle FCBBF30164510//Cadherin domain//Cadherin domain//Cadherin domain//Fructose-bisphosphate aldolase class-I//Cadherin domain//Cadherin domain//Alphaherpesvirus glycoprotein E//Cadherin cytoplasmic region FCBBF30166220//Serine hydroxymethyltransferase FCBBF30169280//PHD-finger//Zinc finger, C3HC4 type (RING finger)

FCBBF30171230//Subtilase family//Proprotein convertase P-domain

FCBBF30173960//Beta-lactamase//TPR Domain

FCBBF30194550//Arsenical pump membrane protein//Ank repeat//Ank repeat//Ank repeat//Ank repeat//Ank repeat//Dehydrogenase E1 component//Ank repeat//Ank repeat//Ank repeat//Ank repeat//Ank repeat//Ank repeat//Ank repeat FCBBF30195690//C2 domain FCBBF30197840//Sushi domain (SCR repeat)//CUB domain//Sushi domain (SCR repeat)//CUB domain//Sushidomain (SCR repeat)//Sushi domain (SCR repeat)//Sushi domain (SCR repeat)

FCBBF30212210//Immunoglobulin domain

FCBBF30215240//PH domain//FERM domain (Band 4.1 family)

FCBBF30220050//Ligand-binding domain of nuclear hormone receptor

FCBBF30222910//Corticotropin-releasing factor family

FCBBF30236670//DEAD/DEAH box helicase

FCBBF30250980//WD domain, G-beta repeat//WD domain, G-beta repeat//WD domain, G-beta repeat//WD domain, G-beta repeat//WD domain, G-beta repeat//WD domain, G-beta repeat FCBBF30255680//Vesicular monoamine transporter//GGL domain//Ezrin/radixin/moesin family//Ank repeat//Ank repeat FCBBF30257370//Geminivirus AL1 protein//Outer membrane efflux protein FCBBF30259050//Zinc finger, C2H2 type//Zinc finger, C2H2 type//Zinc finger, C2H2 type//Zinc finger present in dystrophin, CBP/p300//Zinc finger, C2H2 type//PHD-finger//Zinc finger, C2H2 type//Zinc finger, C2H2 type//DM DNA binding domain//Zinc finger, C2H2 type//Zinc finger, C2H2 type//Zinc finger, C2H2 type//Zinc finger, C2H2 type//Transcription factor S-II (TFIIS)//Zinc finger, C2H2 type//TRAF-type zinc finger//Zinc finger, C2H2 type//Zinc finger, C2H2 type//Zinc finger, C2H2 type//Zinc finger, C2H2 type//Zinc finger, C2H2 type FCBBF30260210//SNF2 and others N-terminal domain//Helicases conserved C-terminal domain//Domain of unknown function DUF94

FCBBF30263080//Zinc finger, C2H2 type//Zinc finger, C2H2 type

FCBBF30266510//Domain of unknown function DUF71

FCBBF30271990//Ank repeat//Ank repeat//Ank repeat//Ank repeat//Ank repeat//Ank repeat//Ank repeat//Ank repeat//Ank repeat//Ank repeat//Ank repeat//Ank repeat FCBBF30275590//LIM domain containing proteins FCBBF30282020//Ank repeat//Ank repeat//Ank repeat//K+ channel tetramerisation domain//BTB/POZ domain FCBBF30285930//Zinc finger, C2H2 type//Zinc finger, C2H2 type//Zinc finger, C2H2 type//Zinc finger, C2H2 type//Zinc finger, C2H2 type FCBBF50001650//MORN motif//MORN motif//MORN motif//MORN motif//MORN motif//MORN motif// MORN motif//MORN motif
FCBBF50003530//Zinc finger, C3HC4 type (RING finger)
FCBBF50004950//Putative replicase 1 (ORF2)
FEBRA20005040//Intermediate filament proteins//Hr1 repeat motif//Troponin//GrpE
FEBRA20007820//DNA polymerase family B
FEBRA20018670//Viral methyltransferase//Ribosomal protein S19//Alpha-2-macroglobulin family N-terminal region
FEBRA20026820//KRAB box//Zinc finger, C2H2 type// Zinc finger, C2H2 type//Zinc finger, C2H2 type//Zinc finger, C2H2 type//Zinc finger, C2H2 type//Putative zinc finger in N-recognin//Zinc finger, C2H2 type//Zinc finger, C2H2 type//Zinc finger, C2H2 type//Zinc finger, C2H2 type//Zinc finger, C2H2 type//Zinc finger, C2H2 type
FEBRA20027070//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type// Zinc finger, C2H2 type//Zinc finger, C2H2 type//Zinc finger, C2H2 type//TRAF-type zinc finger//Zinc finger, C2H2 type//Zinc finger, C2H2 type//Zinc finger, C2H2 type
FEBRA20029620//Leucine Rich Repeat//Leucine Rich Repeat//Leucine Rich Repeat
FEBRA20031000//Leucine Rich Repeat//Leucine Rich Repeat//Leucine Rich Repeat//Leucine Rich Repeat// Leucine Rich Repeat//Leucine Rich Repeat//Insulin/IGF/ Relaxin family//Ribosomal RNA adenine dimethylases// SAM domain (Sterile alpha motif)//TFIIE alpha subunit// Zinc finger, C3HC4 type (RING finger)
FEBRA20031280//Protein of unknown function DUF82
FEBRA20038330//Corticotropin-releasing factor family
FEBRA20038970//Laminin EGF-like (Domains III and V)// Phorbol esters/diacylglycerol binding domain (C1 domain)//EGF-like domain//EGF-like domain//Trypsin Inhibitor like cysteine rich domain//Metallothionein// EGF-like domain//EGF-like domain//Extracellular link domain
FEBRA20046200//Ank repeat//Ank repeat//Ank repeat// Ank repeat//Ank repeat//Ank repeat//Ank repeat
FEBRA20046510//Zinc finger, C2H2 type//Zinc finger, C2H2 type//BolA-like protein//Zinc finger, C2H2 type// Zinc finger, C2H2 type//Zinc finger, C2H2 type//Zinc finger, C2H2 type//Zinc finger, C2H2 type//Zinc finger, C2H2 type//Zinc finger, C2H2 type
FEBRA20063720//KRAB box//Zinc finger, C2H2 type// Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type// Zinc finger, C2H2 type//Zinc finger, C2H2 type//Zinc finger, C2H2 type//Zinc finger, C2H2 type
FEBRA20078800//NADH ubiquinone oxidoreductase, 20 Kd subunit
FEBRA20080860//Hantavirus glycoprotein G2
FEBRA20087550//WD domain, G-beta repeat//WD domain, G-beta repeat
FEBRA20088610//CRAL/TRIO domain.
FEBRA20088810//Fibroblast growth factor
FEBRA20090160//Nuclear transition protein 2
FEBRA20090220//Nucleotidyl transferase//Bacterial transferase hexapeptide (four repeats)//Bacterial transferase hexapeptide (four repeats)//Bacterial transferase hexapeptide (four repeats)//Domain of unknown function DUF29//Peptide hormone//eIF4-gamma/eIF5/eIF2-epsilon
FEBRA20092760//LIM domain containing proteins//LIM domain containing proteins//LIM domain containing proteins
FEBRA20115930//Divalent cation transporter//Translation initiation factor IF-3//Divalent cation transporter
FEBRA20150420//Transient receptor//Borrelia ORF-A// Transient receptor
FEBRA20170240//SCAN domain//KRAB box//Zinc finger, C2H2 type//Zinc finger, C2H2 type//Zinc finger, C2H2 type//Zinc finger, C2H2 type//Zinc finger, C2H2 type
FEBRA20172230//Phospholipase D. Active site motif// Phospholipase D. Active site motif
FEBRA20173330//Eukaryotic protein kinase domain
FEBRA20175330//D-isomer specific 2-hydroxyacid dehydrogenases
FEBRA20191720//GGL domain//Regulator of G protein signaling domain
HCHON10000150//LIM domain containing proteins//LIM domain containing proteins//LIM domain containing proteins//Zinc finger, C3HC4 type (RING finger)
HCHON20000870//Eukaryotic protein kinase domain
HCHON20002650//Zinc finger, C2H2 type//Zinc finger, C2H2 type//Zinc finger, C2H2 type
HCHON20002710//Ubiquitin carboxyl-terminal hydrolase family 2
HCHON20015050//von Willebrand factor type A domain// IPT/TIG domain//Sm protein
HEART10001420//MYND finger//SET domain
HEART10001490//FAD binding domain
HEART20009590//Peptidase family M41
HEART20019310//Zinc finger, C3HC4 type (RING finger)//PHD-finger//B-box zinc finger.
HEART20022200//Influenza Matrix protein (M1)// metallopeptidase family M24
HEART20047640//3'5'-cyclic nucleotide phosphodiesterase//Formin Homology 2 Domain
HEART20082570//C-5 cytosine-specific DNA methylase// Glycine cleavage T-protein (aminomethyl transferase)
HHDPC20081230//RNA recognition motif. (a.k.a. RRM, RBD, or RNP domain)//RNA recognition motif. (a.k.a. RRM, RBD, or RNP domain)//RNA recognition motif. (a.k.a. RRM, RBD, or RNP domain)//RNA recognition motif. (a.k.a. RRM, RBD, or RNP domain)
HHDPC20088160//PDZ domain (Also known as DHR or GLGF).
HLUNG20008460//bZIP transcription factor
HLUNG20011260//Eukaryotic protein kinase domain
HLUNG20011460//RNA recognition motif. (a.k.a. RRM, RBD, or RNP domain)//RNA recognition motif. (a.k.a. RRM, RBD, or RNP domain)
HLUNG20014590//Zinc finger, C2H2 type//Zinc finger, C2H2 type//Putative zinc finger in N-recognin//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type// Transcription factor S-II (TFIIS)//Zinc finger, C2H2 type//Zinc finger, C2H2 type
HLUNG20015070//Leucine rich repeat N-terminal domain//Leucine Rich Repeat//Leucine Rich Repeat// Leucine Rich Repeat//Leucine Rich Repeat//Leucine Rich Repeat//Leucine Rich Repeat//Leucine Rich Repeat// Leucine rich repeat C-terminal domain//Immunoglobulin domain
HLUNG20024050//Rubredoxin
HLUNG20028110//Zinc finger, C3HC4 type (RING finger)//TPR Domain//TPR Domain//TPR Domain//Zinc finger, C3HC4 type (RING finger)//Aldo/keto reductase family HLUNG20030420//Ank repeat//Ank repeat//Ank repeat// Ank repeat//Ank repeat
HLUNG20032460//Prolyl oligopeptidase family//Lipoate-protein ligase B//alpha/beta hydrolase fold
HLUNG20033060//HMG (high mobility group) box
HLUNG20041590//TPR Domain//TPR Domain//Domain of unknown function DUF27
HLUNG20042730//Cytochrome P450
HLUNG20051330//FHIPEP family
HLUNG20063700//Progesterone receptor
HLUNG20065990//bZIP transcription factor//SNAP-25 family//Syntaxin
HLUNG20068120//Fimbrial Usher proteins
HLUNG20069350//EF hand//EF hand//EF hand
HLUNG20070410//Dihydropyridine sensitive L-type calcium channel (Beta subunit)
HLUNG20081390//DnaJ domain
HLUNG20082350//PH domain//START domain
HLUNG20083330//DNA polymerase III beta subunit// Fibrillar collagen C-terminal domain
HLUNG20084790//WD domain, G-beta repeat//WD domain, G-beta repeat//WD domain, G-beta repeat
HLUNG20085210//C2 domain
KIDNE20016360//PAS domain//PAC motif//Ion transport protein//Transmembrane region cyclic Nucleotide Gated Channel//Cyclic nucleotide-binding domain
KIDNE20027980//SAM domain (Sterile alpha motif)
KIDNE20080690//Glycosyl hydrolases family 18// Aminotransferases class-III pyridoxal-phosphate// Methyl-accepting chemotaxis protein (MCP) signaling domain//Aminotransferases class-III pyridoxal-phosphate
KIDNE20081170//Kinesin motor domain//Kinesin motor domain
KIDNE20083620//Asparaginase
KIDNE20084030//Sugar (and other) transporter
KIDNE20084730//Neuraxin and MAP1B proteins//Formin Homology 2 Domain
KIDNE20086490//gag gene protein p24 (core nucleocapsid protein)
KIDNE20087880//Reverse transcriptase (RNA-dependent DNA polymerase)
KIDNE20088240//EF hand//EF hand//EF hand
KIDNE20089870//WD domain, G-beta repeat//WD domain, G-beta repeat//WD domain, G-beta repeat//WD domain, G-beta repeat//WD domain, G-beta repeat//WD domain, G-beta repeat
KIDNE20094670//Sigma-54 interaction domain//FtsK/ SpoIIIE family//ATPases associated with various cellular activities (AAA)
KIDNE20133880//G-protein alpha subunit
KIDNE20141700//Ribosomal family S4e
KIDNE20142900//EGF-like domain//EB module//EGF-like domain//EGF-like domain
KIDNE20148080//Zinc finger, C3HC4 type (RING finger)
KIDNE20149780//Ank repeat//Ank repeat//Ank repeat
KIDNE20152440//Trypsin//PDZ domain (Also known as DHR or GLGF).
KIDNE20154330//PDZ domain (Also known as DHR or GLGF).//PDZ domain (Also known as DHR or GLGF)•//PDZ domain (Also known as DHR or GLGF).//PDZ domain (Also known as DHR or GLGF).//PDZ domain (Also known as DHR or GLGF).//PDZ domain (Also known as DHR or GLGF).
KIDNE20160360//Sec7 domain//PH domain
KIDNE20169180//EGF-like domain//EB module//EGF-like domain//Trypsin Inhibitor like cysteine rich domain// EGF-like domain//TNFR/NGFR cysteine-rich region// Zona pellucida-like domain
KIDNE20170400//Leucine Rich Repeat//Leucine Rich Repeat//Leucine Rich Repeat//Protein kinase C terminal domain//Rubredoxin
KIDNE20173150//Acetyltransferase (GNAT) family
KIDNE20173430//PDZ domain (Also known as DHR or GLGF).//PDZ domain (Also known as DHR or GLGF).
KIDNE20186170//UDP-glucoronosyl and UDP-glucosyl transferases
KIDNE20189960//Trehalase
LIVER20006260//KRAB box//Zinc finger, C2H2 type// Zinc finger, C2H2 type//Zinc finger, C2H2 type//Zinc finger, C2H2 type//Zinc finger, C2H2 type//Zinc finger, C2H2 type//Plant PEC family metallothionein//Zinc finger, C2H2 type//Zinc finger, C2H2 type
LIVER20007750//Sugar (and other) transporter
LIVER20010760//Lectin C-type domain
LIVER20010990//DNA gyrase/topoisomerase IV, subunit A
LIVER20013890//tRNA synthetases class I (C)
LIVER20026440//Cytochrome P450
LIVER20030650//General diffusion Gram-negative porins
LIVER20038000//Mitochondrial carrier proteins// Mitochondrial carrier proteins//Mitochondrial carrier proteins
LIVER20040740//CRAL/TRIO domain.
LIVER20055270//AIR synthase related protein
MESAN20006200//Annexin//Annexin
MESAN20008150//IBR domain
MESAN20009090//CUB domain
MESAN20016270//KRAB box//Zinc finger, C2H2 type// Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type// Zinc finger, C2H2 type
MESAN20021130//SH3 domain//Eukaryotic protein kinase domain
MESAN20021220//Leucine Rich Repeat//Leucine Rich Repeat//Leucine Rich Repeat//Leucine Rich Repeat// Leucine Rich Repeat//Leucine Rich Repeat//Leucine rich repeat C-terminal domain//Leucine rich repeat N-terminal domain//Leucine Rich Repeat//Leucine Rich Repeat// Leucine Rich Repeat//Leucine Rich Repeat//Leucine Rich Repeat//Leucine rich repeat C-terminal domain
MESAN20026870//PAN domain//TBC domain
MESAN20027240//RhoGEF domain
MESAN20027900//von Willebrand factor type A domain// von Willebrand factor type A domain//von Willebrand factor type A domain//Protozoan/cyanobacterial globin// von Willebrand factor type A domain//von Willebrand factor type A domain
MESAN20030350//LGN motif, putative GEF specific for G-alpha GTPase//DNA gyrase/topoisomerase IV, subunit A
MESAN20030370//Porphobilinogen deaminase//GHMP kinases putative ATP-binding proteins//Protein of unknown function DUF113
MESAN20034440//Viral DNA-binding protein// Uncharacterized protein family UPF0024
MESAN20038520//Caspase recruitment domain//RNA polymerase beta subunit
MESAN20057240//Elongation factor TS//Helix-hairpin-helix motif.
MESAN20058110//FKBP-type peptidyl-prolyl cis-trans isomerases//Elongation factor Tu family//FKBP-type peptidyl-prolyl cis-trans isomerases//FKBP-type peptidyl-prolyl cis-trans isomerases
MESAN20059570//EGF-like domain//SEA domain// Immunoglobulin domain MESAN20060430//SET domain
MESAN20067430//Tropomyosins
MESAN20069530//Calponin homology (CH) domain//PDZ domain (Also known as DHR or GLGF).
MESAN20090190//EGF-like domain//EGF-like domain//EGF-like domain//EGF-like domain//EGF-like domain//EGF-like domain//Metallothionein//CUB domain
MESAN20095220//Adaptin N terminal region
MESAN20095800//Cyclophilin type peptidyl-prolyl cis-trans isomerase//RNA recognition motif. (a.k.a. RRM, RBD, or RNP domain)
NT2NE20018890//WD domain, G-beta repeat//WD domain, G-beta repeat//WD domain, G-beta repeat
NT2NE20026200//Transketolase
NT2NE20026510//Zinc finger, C3HC4 type (RING finger)
NT2NE20038870//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Lipoprotein
NT2NE20042550//Viral (Superfamily 1) RNA helicase//NB-ARC domain//Adenylate kinase//Adenylate kinase
NT2NE20053950//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2NE20060750//KRAB box//Zinc finger, C2H2 type
NT2NE20061030//SCAN domain
NT2NE20077270//Adenovirus EB1 55K protein/large t-antigen
NT2NE20079670//KRAB box//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type
NT2NE20087270//Tudor domain
NT2NE20092950//Fibronectin type III domain
NT2NE20108420//Domain of unknown function DUF130//Oxysterol-binding protein
NT2NE20117580//NADH ubiquinone oxidoreductase, 20 Kd subunit
NT2NE20127900//Myo-inositol-1-phosphate synthase
NT2NE20140130//Sema domain
NT2NE20145250//Stathmin family
NT2NE20153620//FERM domain (Band 4.1 family)//PH domain
NT2RI20093010//Tetrahydrofolate dehydrogenase/cyclohydrolase
NT2RP70001120//Ank repeat//Ank repeat//Ank repeat//Insulinase (Peptidase family M16)
NT2RP70001730//BTB/POZ-domain//Kelch motif//Kelch motif//Kelch motif//Kelch motif
NT2RP70003110//Collagen triple helix repeat (20 copies)//Heavy-metal-associated domain
NT2RP70027790//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat
NT2RP70029780//KRAB box//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//Zinc finger, C2H2 type//Transcription factor S-II (TFIIS)
NT2RP70030840//Viral (Superfamily 1) RNA helicase
NT2RP70031070//Nucleoside transporter
NT2RP70031340//PHD-finger
NT2RP70046410//Zinc finger, C2H2 type//Zinc finger, C2H2 type//Zinc finger, C2H2 type
NT2RP70056690//Thrombospondin type 1 domain//Domain of unknown function DUF18//Thrombospondin type 1 domain//Thrombospondin type 1 domain//Thrombospondin type 1 domain//Thrombospondin type 1 domain//Keratin, high sulfur B2 protein
NT2RP70057500//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//DnaJ central domain (4 repeats)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RP70064570//Calpain family cysteine protease//Calpain large subunit, domain III//EF hand//EF hand
NT2RP70075300//KRAB box//Domain of unknown function DUF19//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RP70075800//recA bacterial DNA recombination proteins//WD domain, G-beta repeat//WD domain, G-beta repeat//WD domain, G-beta repeat//WD domain, G-beta repeat//WD domain, G-beta repeat//WD domain, G-beta repeat//SH3 domain
NT2RP70090870//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//DM DNA binding domain//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type
NTONG20005310//Ribosomal protein S9/S16
NTONG20029850//EF hand//EF hand//EF hand
NTONG20031580//Hsp20/alpha crystallin family
NTONG20032100//Intermediate filament proteins
NTONG20034540//GAF domain//GAF domain//3'5'-cyclic nucleotide phosphodiesterase
NTONG20035150//BTB/POZ domain//Kelch motif//Kelch motif//Kelch motif//Kelch motif//Kelch motif
NTONG20043080//Immunoglobulin domain//Immunoglobulin domain//Immunoglobulin domain
NTONG20048440//PH domain//K-box region
NTONG20053630//DNA binding domain with preference for A/T rich regions//Zinc finger, C2H2 type//Zinc finger, C2H2 type//Zinc finger, C2H2 type//Zinc finger, C2H2 type//Progesterone receptor//Zinc finger, C2H2 type
NTONG20053730//Ribosomal protein S2//Ubiquitin carboxyl-terminal hydrolases family 2//Ubiquitin carboxyl-terminal hydrolase family 2
NTONG20053910//Translin family//PH domain//Putative GTP-ase activating protein for Arf//Ank repeat//Ank repeat
NTONG20055200//Calcium channel extracellular region//Elongation factor Tu family//Elongation factor G C-terminus
NTONG20058010//AMP-binding enzyme OCBBF20000740//Leucine rich repeat N-terminal domain//Leucine Rich Repeat//Leucine Rich Repeat//Leucine Rich Repeat//Leucine Rich Repeat//Leucine Rich Repeat//Leucine rich repeat C-terminal domain//Immunoglobulin domain
OCBBF20011860//LIM domain containing proteins
OCBBF20012520//Leucine-rich repeat N-terminal domain//Leucine Rich Repeat//Leucine Rich Repeat//Leucine Rich Repeat//Leucine Rich Repeat//Leucine Rich Repeat//Leucine rich repeat C-terminal domain//Immunoglobulin domain
OCBBF20016390//Chitin synthase//Fibronectin type II domain
OCBBF20016810//'Paired box' domain
OCBBF20110210//Immunoglobulin domain//Immunoglobulin domain//Immunoglobulin domain
OCBBF20113110//AP endonuclease family 1
OCBBF20116250//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type
OCBBF20120010//Thrombospondin type 1 domain
OCBBF20120950//K+ channel tetramerisation domain//BTB/POZ domain//Zinc finger, C2H2 type//Zinc finger, C2H2 type
OCBBF20121910//Ribosomal protein L24e
OCBBF20147070//DNA polymerase (viral) C-terminal domain
OCBBF20156450//KRAB box//Zinc finger, C2H2 type//Zinc finger, C2H2 type//Zinc finger, C2H2 type//Zinc finger, C2H2 type//Zinc finger, C2H2 type
OCBBF20157970//Zinc finger, C2H2 type//Zinc finger, C2H2 type//Zinc finger, C2H2 type//Zinc finger, C2H2 type//Zinc finger, C2H2 type//Zinc finger, C2H2 type//TRAF-type zinc finger//Zinc finger, C2H2 type//Zinc finger, C2H2 type//DM DNA binding domain//Zinc finger, C2H2 type
OCBBF20165910//DnaB-like helicase
OCBBF20166890//CAP-Gly domain//CAP-Gly domain
OCBBF20166900//Zinc finger, C2H2 type//Zinc finger, C2H2 type//Zinc finger, C2H2 type//Transcription factor S-II (TFIIS)//Zinc finger, C2H2 type//Zinc finger, C2H2 type
OCBBF20167290//haloacid dehalogenase-like hydrolase//Thioredoxin//Aminoglycoside phosphotransferase//Acyl-CoA dehydrogenase
OCBBF20174580//Cyclin
OCBBF20174890//Death domain
OCBBF20175360//Zinc finger, C2H2 type
OCBBF20177540//KRAB box//Zinc finger, C2H2 type//Zinc finger, C2H2 type//Zinc finger, C2H2 type//Src homology domain 2//Zinc finger, C2H2 type//Zinc finger, C2H2 type//Zinc finger, C2H2 type
OCBBF20177910//Corticotropin-releasing factor family
OCBBF20182060//Inward rectifier potassium channel
OCBBF20191950//EGF-like domain//Low-density lipoprotein receptor domain class A//Low-density lipoprotein receptor domain class A//EGF-like domain//Low-density lipoprotein receptor domain class A//EGF-like domain//Low-density lipoprotein receptor domain class A//Low-density lipoprotein receptor domain class A//EGF-like domain//EGF-like domain//Low-density lipoprotein receptor repeat class B//Low-density lipoprotein receptor repeat class B//Low-density lipoprotein receptor repeat class B//Low-density lipoprotein receptor repeat class B//Low-density lipoprotein receptor repeat class B//EGF-like domain//60 Kd inner membrane protein
PANCR10000860//Trypsin//Trypsin
PEBLM10001470//Zinc finger, C2H2 type//Fork head domain
PEBLM20001800//Immunoglobulin domain//Immunoglobulin domain//Immunoglobulin domain//Immunoglobulin domain//Immunoglobulin domain
PEBLM20003260//Zinc finger, C2H2 type//Zinc finger, C2H2 type//Transcription factor S-II (TFIIS)//Src homology domain 2//Zinc finger, C2H2 type//Zinc finger, C2H2 type//Src homology domain 2//Zinc finger, C2H2 type
PEBLM20005020//Virion host shutoff protein
PLACE50001390//PHD-finger
PLACE60004260//Cystatin domain
PLACE60006300//Immunoglobulin domain
PLACE60012620//WD domain, G-beta repeat//WD domain, G-beta repeat//WD domain, G-beta repeat//WD domain, G-beta repeat//AN1-like Zinc finger//FYVE zinc finger
PLACE60054230//CheR methyltransferase//Formin Homology 2 Domain
PLACE60054820//Regulator of chromosome condensation (RCC1)//Regulator of chromosome condensation (RCC1)//Regulator of chromosome condensation (RCC1)//Regulator of chromosome condensation (RCC1)
PLACE60054870//IQ calmodulin-binding motif//IQ calmodulin-binding motif
PLACE60055590//Zinc finger, C3HC4 type (RING finger)
PLACE60061370//Phosphotyrosine interaction domain (PTB/PID).//Extracellular link domain
PLACE60062660//Gamma-adaptin, C-terminus
PLACE60064180//Lumenal portion of Cytochrome b559, alpha (gene psbE) subunit. //Viral (Superfamily 1) RNA helicase
PLACE60066970//SCAN domain//Zinc finger, C2H2 type//PHD-finger//Zinc finger, C2H2 type//Zinc finger, C2H2 type//Zinc finger, C2H2 type
PLACE60070500//Immunoglobulin domain//Immunoglobulin domain
PLACE60073090//Myo-inositol-1-phosphate synthase
PLACE60074820//Adenylate kinase
PLACE60082850//Pathogenesis-related protein Bet v I family
PLACE60087680//Thyroglobulin type-1 repeat
PLACE60093380//Penicillin amidase//Bacterial regulatory proteins, lacI family//Vacuolar sorting protein 9 (YPS9) domain
PLACE60095600//DEAD/DEAH box helicase
PLACE60098350//MAGE family
PLACE60104630//Photosystem I reaction centre subunit VIII
PLACE60113340//EGF-like domain//Laminin G domain//Insulin-like growth factor binding proteins//EGF-like domain//Laminin G domain
PLACE60118810//bZIP transcription factor//TPR Domain//TPR Domain//TPR Domain//TPR Domain//PPR repeat
PLACE60119700//EF hand
PLACE60122970//Zinc finger, C2H2 type
PLACE60138840//Syndecan domain//Mitochondrial carrier proteins//Mitochondrial carrier proteins//Mitochondrial carrier proteins
PLACE60140640//Phosphoribulokinase//Shikimate kinase//Uncharacterized protein family UPF0038
PLACE60154450//RhoGAP domain
PLACE60177880//Immunoglobulin domain//Immunoglobulin domain
PLACE60181870//Pentaxin family
PLACE60184870//LBP/BPI/CETP family PROST10001100//Keratin, high sulfur B2 protein
PROST20007170//KRAB box//Zinc finger, C2H2 type//Cyclopropane-fatty-acyl-phospholipid synthase//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type
PROST20015210//Myosin tail//Borrelia lipoproteins//Myosin tail
PROST20016760//'chromo' (CHRromatin Organization MOdifier) domain
PROST20024250//Zinc finger, C2H2 type//Zinc finger, C2H2 type//Zinc finger, C2H2 type//Zinc finger, C2H2 type
PROST20028970//Ank repeat//Ank repeat//Glutamine amidotransferases class-II//Ank repeat//Ank repeat
PROST20033240//Ephrin receptor ligand binding domain//EB module//TNFR/NGFR cysteine-rich region//Fibronectin type III domain
PROST20036350//Glutathione S-transferases. //Ribosomal protein S24e//Interferon alpha/beta domain//tRNA synthetases class I (E and Q)
PROST20045700//Keratin, high sulfur B2 protein
PROST20050390//Cytochrome P450
PROST20051310//DEAD/DEAH box helicase//Toprim domain//Helicases conserved C-terminal domain//Zinc knuckle
PROST20065790//Phosphofructokinase//Phosphofructokinase//Phosphofructokinase//Phosphofructokinase
PROST20073280//Transposase
PROST20075280//Immunoglobulin domain//Immunoglobulin domain//Thrombospondin type 1 domain
PROST20082430//Cyclophilin type peptidyl-prolyl cis-trans isomerase
PROST20084720//Cytochrome P450
PROST20087240//gag gene protein p24 (core nucleocapsid protein)
PROST20099090//Disintegrin
PROST20102190//EF hand//Ribosomal RNA adenine dimethylases//EF hand
PROST20105450//Sodium/hydrogen exchanger family
PROST20127450//TSC-22/dip/bun family
PROST20130320//S-100/ICaBP type calcium binding domain
PROST20152510//TPR Domain//TPR Domain//TPR Domain
PROST20155370//SCAN domain//KRAB box//Zinc finger, C2H2 type//Zinc finger, C2H2 type//Zinc finger, C2H2 type//Zinc finger, C2H2 type//Zinc finger, C2H2 type
PROST20168600//KTN NAD-binding domain
PUAEN10000650//TSC-22/dip/bun family
PUAEN10001640//Leucine Rich Repeat//Leucine Rich Repeat//Leucine Rich Repeat//Leucine Rich Repeat
PUAEN20000800//Bleomycin resistance protein
PUAEN20001520//Acetyltransferase (GNAT) family
PUAEN20002470//FtsK/SpoIIIE family
PUAEN20003120//Myb-like DNA-binding domain//ATP synthase ab C terminal//SET domain
SALGL10001070//Family 4 glycosyl hydrolase
SKMUS20006790//von Willebrand factor type D domain
SKMUS20007260//Syndecan domain
SKMUS20008730//Calponin homology (CH) domain
SKMUS20017400//Hantavirus nucleocapsid protein//Tropomyosins
SKMUS20040440//Ribosomal protein L3
SKMUS20091900//Trypsin
SKNMC10001230//Ank repeat//Ank repeat//Ank repeat
SKNMC20006350//FKBP-type peptidyl-prolyl cis-trans isomerases//FKBP-type peptidyl-prolyl cis-trans isomerases//FKBP-type peptidyl-prolyl cis-trans isomerases//EF hand//EF hand
SKNSH20009710//Tropomyosins//Tropomyosins
SKNSH20052400//WD domain, G-beta repeat//WD domain, G-beta repeat//WD domain, G-beta repeat//WD domain, G-beta repeat//WD domain, G-beta repeat//WD domain, G-beta repeat//WD domain, G-beta repeat
SKNSH20057920//Eukaryotic protein kinase domain
SMINT20000070//Rabphilin-3A effector domain
SMINT20002320//Protein phosphatase 2A regulatory B subunit (B56 family)
SMINT20006020//PH domain//Phorbol esters/diacylglycerol binding domain (C1 domain)//FYVE zinc finger//PH domain
SMINT20006090//Glutathione S-transferases.
SMINT20008110//Na+/K+ ATPase C-terminus
SMINT20011950//KRAB box//Zinc finger, C2H2 type//Zinc finger, C2H2 type//Zinc finger, C2H2 type//Zinc finger, C2H2 type//PHD-finger//Zinc finger, C2H2 type
SMINT20012220//Collagen triple helix repeat (20 copies)
SMINT20016150//gag gene protein p17 (matrix protein). //Ferritins
SMINT20024140//Immunoglobulin domain
SMINT20028800//Zinc finger, C2HC type//SAM domain (Sterile alpha motif)//Sterile alpha motif (SAM)/Pointed domain
SMINT20028840//Immunoglobulin domain
SMINT20030740//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
SMINT20035050//SH3 domain//WW domain//PH domain//RhoGAP domain
SMINT20036440//ENTH domain
SMINT20038660//Olfactomedin-like domain
SMINT20039050//Flavivirus glycoprotein//IBR domain
SMINT20043390//Ras association (RalGDS/AF-6) domain
SMINT20044140//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type
SMINT20044730//Envelope glycoprotein GP120
SMINT20048720//Cytochrome P450//Cytochrome P450
SMINT20052130//Ank repeat//Ank repeat
SMINT20056230//Immunoglobulin domain//Immunoglobulin domain//Immunoglobulin domain//Immunoglobulin domain
SMINT20062050//Reverse transcriptase (RNA-dependent DNA polymerase)
SMINT20077960//Gelsolin repeat. //Gelsolin repeat. //Gelsolin repeat. //Gelsolin repeat.
SMINT20083290//Immunoglobulin domain//Immunoglobulin domain//Immunoglobulin domain//Immunoglobulin domain//Immunoglobulin domain
SMINT20086250//Glycine cleavage H-protein
SMINT20086720//SCAN domain//KRAB box
SMINT20088440//Immunoglobulin domain
SMINT20089600//PDZ domain (Also known as DHR or GLGF).

SMINT20091190//Immunoglobulin domain//Immunoglobulin domain//Immunoglobulin domain//Immunoglobulin domain//Immunoglobulin domain
SPLEN20006950//Reverse transcriptase (RNA-dependent DNA polymerase)
SPLEN20011350//Helper component proteinase
SPLEN20015100//DHHC zinc finger domain
SPLEN20023540//RasGEF domain//EF hand//EF hand
SPLEN20023850//RecF protein//SMC domain N terminal domain//Tropomyosins
SPLEN20024190//EGF-like domain//EB module//EGF-like domain//Trypsin Inhibitor like cysteine rich domain//EGF-like domain//EGF-like domain//WAP-type (Whey Acidic Protein) 'four-disulfide core'//EGF-like domain
SPLEN20024930//Inositol polyphosphate phosphatase family, catalytic domain
SPLEN20039180//Fatty acid desaturase
SPLEN20042200//Zinc finger, C3HC4 type (RING finger)//Zinc finger, C2H2 type//Zinc finger, C2H2 type//Zinc finger, C2H2 type//Zinc finger, C2H2 type
SPLEN20049840//Polyphosphate kinase//Myosin head (motor domain)//IQ calmodulin-binding motif//SH3 domain
SPLEN20050090//Pyridoxamine 5'-phosphate oxidase//GRIP domain
SPLEN20054500//Renal dipeptidase
SPLEN20055600//K+ channel tetramerisation domain//BTB/POZ domain//Zinc finger, C2H2 type
SPLEN20057900//Scorpion short toxins//EGF-like domain//EGF-like domain//Keratin, high sulfur B2 protein
SPLEN20059270//Zinc finger, C3HC4 type (RING finger)//B-box zinc finger. //SPRY domain
SPLEN20063250//Zinc finger, C2H2 type
SPLEN20063890//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat
SPLEN20071820//DNA polymerase X family
SPLEN20076470//TPR Domain//TPR Domain//TPR Domain
SPLEN20080070//Alpha-L-fucosidase
SPLEN20085910//Double-stranded RNA binding motif
SPLEN20090880//Immunoglobulin domain
SPLEN20098030//Zinc finger, C3HC4 type (RING finger)//B-box zinc finger.
SPLEN20101950//Sodium/hydrogen exchanger family
SPLEN20104150//Ribosomal protein L36
SPLEN20108000//short chain dehydrogenase
SPLEN20110180//Transposase
SPLEN20118050//Leucine rich repeat N-terminal domain//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat
SPLEN20135030//PDZ domain (Also known as DHR or GLGF). //GATA zinc finger//LIM domain containing proteins
SPLEN20139100//Sodium and potassium ATPases//Immunoglobulin domain//Immunoglobulin domain//Immunoglobulin domain//Immunoglobulin domain
SPLEN20139360//Bacterial regulatory proteins, lacI family//Site-specific recombinases
SPLEN20175920//Uncharacterized protein family UPF0036
SPLEN20180980//Glutathione S-transferases.
SPLEN20182990//BTB/POZ domain//Kelch motif//Kelch motif//Kelch motif//Kelch motif
SPLEN20183020//Laminin G domain
SPLEN20191020//Src homology domain 2
SPLEN20193790//Dynamin family//Dynamin family//Proteasome activator pa28 beta subunit//Peroxidase//Dynamin central region//Dynamin GTPase effector domain
SPLEN20195710//TPR Domain//TPR Domain//TPR Domain
SPLEN20197930//K-box region
SPLEN20198390//WD domain, G-beta repeat//Fibrillarin//WD domain, G-beta repeat//WD domain, G-beta repeat//WD domain, G-beta repeat//WD domain, G-beta repeat//WD domain, G-beta repeat//WD domain, G-beta repeat
SPLEN20201830//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat
TESTI10001570//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type//TRAF-type zinc finger//Zinc finger, C2H2 type//Zinc finger, C2H2 type//Zinc finger, C2H2 type//Zinc finger, C2H2 type//Transcription factor S-II (TFIIS)//Zinc finger, C2H2 type
TESTI20006160//Large-conductance mechanosensitive channel, MscL//CbiM
TESTI20006830//PWWP domain
TESTI20012080//Chitin synthase
TESTI20016970//TPR Domain
TESTI20030200//Double-stranded RNA binding motif//Adenosine-deaminase (editase) domain//Adenosine-deaminase (editase) domain
TESTI20030440//Plant PEC family metallothionein//Tropomyosins
TESTI20031310//Serpins (serine protease inhibitors)
TESTI20038240//Peptidase family M13
TESTI20041630//Outer membrane efflux protein//Intermediate filament proteins
TESTI20043910//IQ calmodulin-binding motif//IQ calmodulin-binding motif//IQ calmodulin-binding motif//IQ calmodulin-binding motif//IQ calmodulin-binding motif
TESTI20045390//Immunoglobulin domain//Immunoglobulin domain//Immunoglobulin domain//Immunoglobulin domain//Immunoglobulin domain//Immunoglobulin domain//Immunoglobulin domain
TESTI20046110//Extracellular link domain
TESTI20046490//LIM domain containing proteins//Somatomedin B domain
TESTI20046870//CRAL/TRIO domain. //CRAL/TRIO domain. //MSP (Major sperm protein) domain
TESTI20046890//PHD-finger
TESTI20049060//Immunoglobulin domain
TESTI20049410//Proprotein convertase P-domain
TESTI20050720//Coenzyme A transferase//Alpha-2-macroglobulin family N-terminal region//Coenzyme A transferase
TESTI20051730//Glutamine amidotransferases class-II//alpha/beta hydrolase fold
TESTI20053070//WD domain, G-beta repeat//WD domain, G-beta repeat
TESTI20053950//IQ calmodulin-binding motif
TESTI20055880//Serum amyloid A protein
TESTI20056030//Myosin tail
TESTI20057430//KRAB box//Zinc finger, C2H2 type//Zinc finger, C2H2 type//Zinc finger, C2H2 type//PHD-finger//

Zinc finger, C2H2 type//Zinc finger, C2H2 type//Transcription factor S-II (TFIIS)//Zinc finger, C2H2 type//Zinc finger, C2H2 type
TESTI20057590//Leucine rich repeat C-terminal domain//Immunoglobulin domain
TESTI20057840//SAP domain//Zinc knuckle//Zinc finger, C3HC4 type (RING finger)
TESTI20057880//Zinc finger, C3HC4 type (RING finger)
TESTI20058350//Polyomavirus coat protein//WD domain, G-beta repeat//WD domain, G-beta repeat//WD domain, G-beta repeat//WD domain, G-beta repeat//WD domain, G-beta repeat
TESTI20058920//Tubulin/FtsZ family
TESTI20059080//Thermophilic metalloprotease (M29)//Hyaluronidase
TESTI20059480//Cyclic nucleotide-binding domain
TESTI20059810//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//DM DNA binding domain//Zinc finger, C2H2 type//Zinc finger, C2H2 type//BolA-like protein//Zinc finger, C2H2 type//Coronavirus M matrix/glycoprotein//Zinc finger, C2H2 type//Zinc finger, C2H2 type
TESTI20060350//bZIP transcription factor
TESTI20060830//ZAP domain//Ferric uptake regulator family//Peptidase family M1//Piwi domain
TESTI20061090//Keratin, high sulfur B2 protein
TESTI20061200//Sugar (and other) transporter
TESTI20064370//TPR Domain//TPR Domain//TPR Domain//TPR Domain//Synaptobrevin
TESTI20064530//WD domain, G-beta repeat//WD domain, G-beta repeat//WD domain, G-beta repeat//WD domain, G-beta repeat//WD domain, G-beta repeat//WD domain, G-beta repeat
TESTI20064650//Myosin head (motor domain)
TESTI20065650//G-protein alpha subunit
TESTI20066150//Picornavirus 2B protein//Glutamine amidotransferase class-I//Pancreatic hormone peptides
TESTI20066330//Fibronectin type III domain
TESTI20066650//RasGEF domain
TESTI20067480//KRAB box//Zinc finger, C2H2 type//TRAF-type zinc finger//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//FYVE zinc finger//Zinc finger, C2H2 type//Zinc finger, C2H2 type//Zinc finger, C2H2 type
TESTI20068530//Zinc finger, C3HC4 type (RING finger)//PHD-finger
TESTI20071130//ATP synthase Alpha chain, C terminal
TESTI20071630//Glutamine synthetase//SCP-like extracellular protein
TESTI20075240//KRAB box//Zinc finger, C2H2 type//Zinc finger, C2H2 type//Putative zinc finger in N-recognin//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type
TESTI20076570//Dual specificity phosphatase, catalytic domain
TESTI20079220//KRAB box//Myb-like DNA-binding domain//Myb-like DNA-binding domain//Zinc finger, C2H2 type//Zinc finger, C2H2 type//Zinc finger, C2H2 type//PHD-finger//Transcription factor S-II (TFIIS)//Zinc finger, C2H2 type//Zinc finger, C2H2 type//Zinc finger, C2H2 type
TESTI20079980//PDZ domain (Also known as DHR or GLGF). //Domain found in Dishevelled, Eg1-10, and Pleckstrin
TESTI20081890//PDZ domain (Also known as DHR or GLGF).
TESTI20084250//Oxysterol-binding protein
TESTI20086840//von Willebrand factor type A domain
TESTI20088840//Zinc finger, C3HC4 type (RING finger)//PHD-finger//Thymidine kinases//E7 protein, Early protein//CONSTANS family zinc finger//B-box zinc finger.//SPRY domain
TESTI20092170//ENV polyprotein (coat polyprotein)
TESTI20095200//7TM chemoreceptor
TESTI20095770//WD domain, G-beta repeat//WD domain, G-beta repeat//WD domain, G-beta repeat//WD domain, G-beta repeat//WD domain, G-beta repeat//WD domain, G-beta repeat//WD domain, G-beta repeat
TESTI20095880//Domain of unknown function DUF33//Penicillin amidase//Formate/nitrite transporter//Sodium:galactoside symporter family
TESTI20099350//GGL domain//Clusterin//Biopterin-dependent aromatic amino acid hydroxylase
TESTI20100090//Lectin C-type domain
TESTI20104090//TEA domain
TESTI20105910//Notch (DSL) domain//Amiloride-sensitive sodium channel
TESTI20106170//WD domain, G-beta repeat//WD domain, G-beta repeat//WD domain, G-beta repeat//WD domain, G-beta repeat//WD domain, G-beta repeat
TESTI20106820//Protein kinase C terminal domain
TESTI20108060//Ser/Thr protein phosphatase
TESTI20112540//Leucine Rich Repeat//Leucine Rich Repeat//Leucine Rich Repeat//Leucine Rich Repeat//Chorismate synthase//UvrB/uvrC motif
TESTI20112860//Eukaryotic protein kinase domain
TESTI20113940//Divalent cation transporter
TESTI20114480//Zinc finger, C4 type (two domains)//Zinc finger, C2HC type//SAM domain (Sterile alpha motif)//Sterile alpha motif (SAM)/Pointed domain
TESTI20116050//UBX domain
TESTI20120500//Kelch motif//Kelch motif
TESTI20120900//DNA gyrase/topoisomerase IV, subunit A
TESTI20121040//Protein phosphatase 2C//Protein phosphatase 2C
TESTI20122070//ELM2 domain//Myb-like DNA-binding domain
TESTI20125280//Immunoglobulin domain//Immunoglobulin domain
TESTI20125920//PCI domain
TESTI20126280//recA bacterial DNA recombination proteins
TESTI20131440//Carboxypeptidase activation peptide//Zinc carboxypeptidase
TESTI20132310//Ubiquitin carboxyl-terminal hydrolase family 2
TESTI20134680//MYND finger//B-box zinc finger.//CONSTANS family zinc finger//Putative zinc finger in N-recognin
TESTI20134970//Double-stranded RNA binding motif//Aldehyde oxidase and xanthine dehydrogenase, C terminus//Adenosine-deaminase (editase) domain
TESTI20140970//Immunoglobulin domain
TESTI20145780//Src homology domain 2
TESTI20148380//TPR Domain//TPR Domain//TPR Domain//TPR Domain//TPR Domain//TPR Domain//PPR repeat//Neuraminidases//ATP synthase Alpha chain, C terminal//TPR Domain//TPR Domain//TPR Domain//TPR Domain//PPR repeat//TPR Domain TESTI20150420//RhoGAP domain
TESTI20150920//Leucine Rich Repeat//Leucine Rich Repeat//Leucine Rich Repeat//Leucine Rich Repeat//Leucine Rich Repeat
TESTI20153310//Intermediate filament tail domain
TESTI20162780//Divalent cation transporter
TESTI20162980//Ubiquitin family//Retroviral aspartyl protease//Retroviral aspartyl protease
TESTI20164210//Isocitrate and isopropylmalate dehydrogenases//Ribosomal protein S27a//TILa domain//von Willebrand factor type C domain
TESTI20165990//Ribosomal protein L36
TESTI20166290//Zinc finger, C2H2 type//FAD binding domain//Phosphoenolpyruvate carboxykinase//Ribosomal protein S11
TESTI20166670//Zinc finger C-x8-C-x5-C-x3-H type (SEQ ID NO: 4097) (and similar).
TESTI20169500//GGL domain
TESTI20170280//Flagellar L-ring protein
TESTI20173960//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type
TESTI20179230//Dihydropyridine sensitive L-type calcium channel (Beta subunit)
TESTI20182760//Amiloride-sensitive sodium channel
TESTI20183680//Gas vesicles protein GVPc repeated domain
TESTI20184750//Laminin G domain//Thrombospondin N-terminal—like domains//Laminin G domain
TESTI20184760//Zinc finger, C2H2 type//Zinc finger, C2H2 type//Zinc finger, C2H2 type//PHD-finger//Transcription factor S-II (TFIIS)//Zinc finger, C2H2 type//Zinc finger, C2H2 type//Zinc finger, C2H2 type
TESTI20186110//Divalent cation transporter//Translation initiation factor IF-3//Divalent cation transporter
TESTI20193080//Growth-Arrest-Specific Protein 2 Domain
TESTI20194880//SAP domain
TESTI20196690//Glycine cleavage T-protein (aminomethyl transferase)
TESTI20197030//Pancreatic hormone peptides
TESTI20197600//Zinc finger, C2H2 type//Zinc finger, C2H2 type//Zinc finger, C2H2 type//Zinc finger, C2H2 type
TESTI20199110//Disintegrin
TESTI20205100//DNA gyrase/topoisomerase IV, subunit A
TESTI20205250//MORN motif//MORN motif//MORN motif//MORN motif//MORN motif//MORN motif//MORN motif
TESTI20207170//Nucleosome assembly protein (NAP)
TESTI20210570//CRAL/TRIO domain.
TESTI20212970//DEAD/DEAH box helicase//Helicases conserved C-terminal domain
TESTI20219110//Eukaryotic protein kinase domain
TESTI20222030//Hemagglutinin//ATP synthase Alpha chain, C terminal//AMP-binding enzyme
TESTI20222460//Intermediate filament proteins
TESTI20227380//DEAD/DEAH box helicase//Helicases conserved C-terminal domain
TESTI20228120//RhoGAP domain
TESTI20228740//Zinc finger, C2H2 type
TESTI20244220//Cecropin family//Fes/CIP4 homology domain//Hr1 repeat motif//SH3 domain
TESTI20244430//Ank repeat//Ank repeat//Ank repeat//SAM domain (Sterile alpha motif)
TESTI20244460//pKID domain//Adenylate kinase//Thymidylate kinase//ATPases associated with various cellular activities (AAA)
TESTI20246480//RNA recognition motif. (a.k.a. RRM, RBD, or RNP domain)
TESTI20251610//Chitin synthase//von Willebrand factor type A domain
TESTI20252690//Domain found in Dishevelled, Egl-10, and Pleckstrin
TESTI20254030//LIM domain containing proteins//LIM domain containing proteins//Villin headpiece domain
TESTI20254990//Zinc finger, C2H2 type//Zinc finger, C2H2 type//Zinc finger, C2H2 type
TESTI20255460//ZAP domain//Piwi domain
TESTI20257910//Class I Histocompatibility antigen, domains alpha 1 and 2//Immunoglobulin domain
TESTI20258720//Ank repeat//Ank repeat//Ank repeat
TESTI20259110//Zinc finger, C3HC4 type (RING finger)//PHD-finger
TESTI20261040//DNA polymerase (viral) C-terminal domain
TESTI20261160//PH domain
TESTI20261680//Hsp20/alpha crystallin family//Granulins
TESTI20262150//Ion transport protein
TESTI20262940//Phosphofructokinase
TESTI20264530//WD domain, G-beta repeat//WD domain, G-beta repeat//WD domain, G-beta repeat//WD domain, G-beta repeat//WD domain, G-beta repeat//C. elegans integral membrane protein Srb//WD domain, G-beta repeat//WD domain, G-beta repeat//SAM domain (Sterile alpha motif)//Sterile alpha motif (SAM)/Pointed domain
TESTI20264910//Uteroglobin family
TESTI20266050//Zinc finger, C3HC4 type (RING finger)//SPRY domain
TESTI20274960//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type
TESTI20278280//PMP-22/EMP/MP20/Claudin family
TESTI20282530//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
TESTI20284260//Histone-like transcription factor (CBF/NF—Y) and archaeal histone//Core histone H2A/H2B/H3/H4
TESTI20285230//Adenosine-deaminase (editase) domain
THYMU10004280//NHL repeat//NHL repeat
THYMU20006020//Isocitrate and isopropylmalate dehydrogenases
THYMU20009500//TPR Domain
THYMU20013250//LIM domain containing proteins//RIO1/ZK632.3/MJ0444 family//Eukaryotic protein kinase domain
THYMU20018250//TPR Domain
THYMU20019260//Zinc finger, C2H2 type//Zinc finger, C2H2 type//Zinc finger, C2H2 type//Zinc finger, C2H2 type
THYMU20021090//SAM domain (Sterile alpha motif)//Sterile alpha motif (SAM)/Pointed domain
THYMU20028150//Immunoglobulin domain//Immunoglobulin domain//Immunoglobulin domain//Immunoglobulin domain
THYMU20028410//BRCA1 C Terminus (BRCT) domain//BRCA1 C Terminus (BRCT) domain
THYMU20031330//4Fe-4S iron sulfur cluster binding proteins, NifH/frxC family THYMU20032820//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type THYMU20039320//WD domain, G-beta repeat//WD domain, G-beta repeat//WD domain, G-beta repeat//WD domain, G-beta repeat THYMU20046350//Cytochrome C and Quinol oxidase polypeptide I THYMU20049060//RNA recognition motif. (a.k.a. RRM, RBD, or RNP domain)

THYMU20052830//Immunoglobulin domain//Immunoglobulin domain//Immunoglobulin domain//Immunoglobulin domain THYMU20055450//*Zona pellucida*-like domain THYMU20055460//Putative esterase THYMU20055760//Na+/K+ATPase C-terminus//Phospholipase A2

THYMU20062770//*Zona pellucida*-like domain

THYMU20063650//Ribulose-phosphate 3 epimerase family//Indole-3-glycerol phosphate synthases THYMU20066660//DEAD/DEAH box helicase THYMU20070250//Transketolase//Dehydrogenase E1 component//Transketolase THYMU20071120//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type THYMU20077250//HMG (high mobility group) box THYMU20081110//LIM domain containing proteins THYMU20083390//11S plant seed storage protein THYMU20090230//RNA recognition motif. (a.k.a. RRM, RBD, or RNP domain)

THYMU20095920//Iron hydrogenase small subunit

THYMU20097920//PH domain//FERM domain (Band 4.1 family)

THYMU20098350//bZIP transcription factor//bZIP transcription factor//Tubulin/FtsZ family//Intermediate filament proteins THYMU20099060//Immunoglobulin domain//Immunoglobulin domain//Immunoglobulin domain//Immunoglobulin domain//Immunoglobulin domain THYMU20100940//Protein of unknown function DUF132

THYMU20104480//RNA recognition motif. (a.k.a. RRM, RBD, or RNP domain)

THYMU20106990//PH domain

THYMU20110720//Aminotransferases class-III pyridoxal-phosphate

THYMU20112590//Acyl-CoA dehydrogenase//Adaptin N terminal region

THYMU20120240//Ubiquitin carboxyl-terminal hydrolases family 2//Ubiquitin carboxyl-terminal hydrolase family 2

THYMU20120730//Aldehyde dehydrogenase family

THYMU20121040//bZIP transcription factor//EF-1 guanine nucleotide exchange domain THYMU20139160//Uncharacterized protein family UPF0031

THYMU20143230//EGF-like domain//Extracellular link domain//Fasciclin domain

THYMU20145990//SH3 domain

THYMU20153210//7 transmembrane receptor (Secretin family)

THYMU20170230//Glycine cleavage T-protein (aminomethyl transferase)

THYMU20176010//WD domain, G-beta repeat//PQQ enzyme repeat//WD domain, G-beta repeat//WD domain, G-beta repeat//WD domain, G-beta repeat//WD domain, G-beta repeat//WD domain, G-beta repeat//WD domain, G-beta repeat THYMU20178440//Immunoglobulin domain//Immunoglobulin domain//Immunoglobulin domain//Immunoglobulin domain THYMU20184550//HSF-type DNA-binding domain//bZIP transcription factor THYMU20191970//Cadherin domain//Cadherin domain//Cadherin domain//Cadherin domain TKIDN10000620//Thioredoxin TKIDN10001920//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type TRACH20011010//5'-nucleotidase TRACH20021380//Copper/zinc superoxide dismutase (SODC)//Adenylate and Guanylate cyclase catalytic domain//Adenylate and Guanylate cyclase catalytic domain TRACH20029880//MORN motif//MORN motif//Penicillin amidase//Bacterial regulatory proteins, lacI family//Vacuolar sorting protein 9 (VPS9) domain TRACH20040390//Pumilio-family RNA binding domains (aka PUM-HD, Pumilio homology domain)//Pumilio-family RNA binding domains (aka PUM-HD, Pumilio homology domain)//Pumilio-family RNA binding domains (aka PUM-HD, Pumilio homology domain)//Pumilio-family RNA binding domains (aka PUM-HD, Pumilio homology domain)//Pumilio-family RNA binding domains (aka PUM-HD, Pumilio homology domain)//Pumilio-family RNA binding domains (aka PUM-HD, Pumilio homology domain)//Pumilio-family RNA binding domains (aka PUM-HD, Pumilio homology domain)//Pumilio-family RNA binding domains (aka PUM-HD, Pumilio homology domain)

TRACH20043360//Kinesin motor domain//Caspase recruitment domain//Ribosomal protein L35

TRACH20058000//Fibronectin type III domain

TRACH20090060//C2 domain

TRACH20091070//Aldehyde dehydrogenase family

TRACH20093400//Adaptin N terminal region

TRACH20098510//Ribosomal L29 protein

TRACH20104510//Uncharacterized protein family UPF0005

TRACH20108240//RNA recognition motif. (a.k.a. RRM, RBD, or RNP domain)//RNA recognition motif. (a.k.a. RRM, RBD, or RNP domain)

TRACH20113020//AIR synthase related protein

TRACH20122980//TPR Domain//TPR Domain//TPR Domain//TPR Domain//TPR Domain

TRACH20131230//PH domain//Oxysterol-binding protein

TRACH20139280//PX domain

TRACH20143710//Leucine Rich Repeat//Leucine Rich Repeat//Leucine Rich Repeat

TRACH20149500//Zinc finger//Plexin repeat//Cysteine rich repeat//Intermediate filament proteins TRACH20149740//Sodium:dicarboxylate symporter family TRACH20163470//Putative integral membrane protein DUF46//Sugar (and other) transporter//Sodium:galactoside symporter family TRACH20164100//Retroviral aspartyl protease TRACH20164810//D-isomer specific 2-hydroxyacid dehydrogenases TRACH20167090//Chitinases, family 2

TRACH20170860//Immunoglobulin domain//Immunoglobulin domain//Immunoglobulin domain//Immunoglobulin domain
TRACH20188350//Tropomyosins
TRACH20190460//Lipase (class 3)
UTERU20000950//WD domain, G-beta repeat//WD domain, G-beta repeat//WD domain, G-beta repeat//WD domain, G-beta repeat//WD domain, G-beta repeat
UTERU20016580//Zinc finger present in dystrophin, CBP/p300//Myb-like DNA-binding domain
UTERU20026620//Zinc finger, C2H2 type//Zinc finger, C2H2 type//Zinc finger, C2H2 type//Zinc finger, C2H2 type//Zinc finger, C2H2 type
UTERU20041630//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type
UTERU20083020//Domain of unknown function DUF71
UTERU20086530//Lipocalin/cytosolic fatty-acid binding protein family
UTERU20087070//Sushi domain (SCR repeat)//Trypsin
UTERU20089390//TPR Domain//TPR Domain//TPR Domain//TPR Domain//TPR Domain//TPR Domain//TPR Domain//TPR Domain
UTERU20089620//Fringe-like
UTERU20099040//Cation efflux family
UTERU20099510//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type
UTERU20104310//RNA polymerases K/14 to 18 kDa subunit
UTERU20121140//Rhodanese-like domain
UTERU20122520//FERM domain (Band 4.1 family)//FERM domain (Band 4.1 family)
UTERU20127030//*Xylose isomerase*//ApbE family
UTERU20127150//Translation initiation factor IF-3//Divalent cation transporter
UTERU20128560//Domain of unknown function DUF28
UTERU20132620//HMG14 and HMG17
UTERU20139760//Mitochondrial carrier proteins//Mitochondrial carrier proteins
UTERU20168960//PH domain//Methanol dehydrogenase beta subunit
UTERU20181270//Zinc knuckle
UTERU20185220//Bromodomain

EXAMPLE 6

Functional Categorization Based on the Full-length Nucleotide Sequences

The functional prediction and categorization of the proteins encoded by the clones were carried out based on the result of homology search of the databases of GenBank, Swiss-Prot, UniGene and nr (see the Homology Search Result Data) for the full-length nucleotide sequences and the result of domain search of the amino acid sequences deduced from the full-length nucleotide sequences (see Example 5).

The clone predicted to belong to the category of secretory protein/membrane protein means a clone having hit data with some annotation, such as growth factor, cytokine, hormone, signal, transmembrane, membrane, extracellular matrix, receptor, G-protein coupled receptor, ionic channel, voltage-gated channel, calcium channel, cell adhesion, collagen, connective tissue, etc., suggesting that it is a secretory or membrane protein, or means a clone in which the presence of nucleotide sequence encoding a signal sequence or transmembrane domain was suggested by the results of PSORT and SOSUI analyses for deduced ORF.

The clone predicted to belong to the category of glycoprotein-related protein means a clone having hit data with some annotation, such as glycoprotein, suggesting that the clone encodes a glycoprotein-related protein.

The clone predicted to belong to the category of signal transduction-related protein means a clone having hit data with some annotation, such as serine/threonine-protein kinase, tyrosine-protein kinase, SH3 domain, SH2 domain, etc., suggesting that the clone encodes a signal transduction-related protein.

The clone predicted to belong to the category of transcription-related protein means a clone having hit data with some annotation, such as transcription regulation, zinc finger, homeobox, etc., suggesting that the clone encodes a transcription-related protein.

The clone predicted to belong to the category of disease-related protein means a clone having hit data with some annotation, such as disease mutation, syndrome, etc., suggesting that the clone encodes a disease-related protein, or means a clone whose full-length nucleotide sequence has hit data for Swiss-Prot, GenBank, or UniGene, where the hit data corresponds to genes or proteins which have been deposited in the Online Mendelian Inheritance in Man (OMIM) (http://www.ncbi.nlm.nih.gov/Omim/), which is the human gene and disease database.

The clone predicted to belong to the category of enzyme and/or metabolism-related protein means a clone having hit data with some annotation, such as metabolism, oxidoreductase, E. C. No. (Enzyme commission number), etc., suggesting that the clone encodes an enzyme and/or metabolism-related protein.

The clone predicted to belong to the category of cell division and/or cell proliferation-related protein means a clone having hit data with some annotation, such as cell division, cell cycle, mitosis, chromosomal protein, cell growth, apoptosis, etc., suggesting that the clone encodes a cell division and/or cell proliferation-related protein.

The clone predicted to belong to the category of cytoskeleton-related protein means a clone having hit data with some annotation, such as structural protein, cytoskeleton, actin-binding, microtubles, etc., suggesting that the clone encodes a cytoskeleton-related protein.

The clone which is predicted to belong to the category of nuclear protein and/or RNA synthesis-related protein means a clone having hit data with some annotation, such as nuclear protein, RNA splicing, RNA processing, RNA helicase, polyadenylation, etc., suggesting that the clone encodes a nuclear protein and/or RNA synthesis-related protein.

The clone predicted to belong to the category of protein synthesis and/or transport-related protein means a clone having hit data with some annotation, such as translation regulation, protein biosynthesis, amino-acid biosynthesis, ribosomal protein, protein transport, signal recognition particle, etc., suggesting that the clone encodes a protein synthesis and/or transport-related protein.

The clone predicted to belong to the category of cellular defense-related protein means a clone having hit data with some annotation, such as heat shock, DNA repair, DNA damage, etc., suggesting that the clone encodes a cellular defense-related protein.

The clone predicted to belong to the category of development and/or differentiation-related proteins means a clone having hit data with some annotation, such as developmental protein, etc., suggesting that the clone encodes a development and/or differentiation-related protein.

The clone predicted to belong to the category of DNA-binding and/or RNA-binding protein means a clone having hit data with some annotation, such as DNA-binding, RNA-binding, etc.

The clone predicted to belong to the category of ATP-binding and/or GTP-binding protein means a clone having hit data with some annotation, such as ATP-binding, GTP-binding, etc.

In this functional categorization, when a single clone corresponded to multiple categories of those shown above, the clone was assigned to the multiple categories. However, the function of a protein is not restricted to the functional category in this classification, and there is the possibility that other functions are newly assigned to the protein.

The clones predicted to belong to the category of secretory protein and/or membrane protein are the following 516 clones.

ADRGL20020290, ADRGL20021910,
ADRGL20036380, ADRGL20036840,
ADRGL20059610, ADRGL20063770,
ADRGL20066770, ASTRO20010010,
ASTRO20020240, ASTRO20045840,
ASTRO20053430, ASTRO20055530,
ASTRO20055570, ASTRO20055930,
ASTRO20088950, ASTRO20091180,
BNGH420021680, BNGH420023870,
BNGH420046790, BNGH420052350,
BNGH420059680, BNGH420075940,
BNGH420077980, BRACE10000510,
BRACE20051930, BRACE20052530,
BRACE20054080, BRACE20066360,
BRACE20068710, BRACE20069000,
BRACE20069110, BRACE20194670,
BBACE20204670, BRACE20216950,
BRAMY10001730, BRAMY20003880,
BRAMY20013670, BRAMY20024790,
BRAMY20027390, BRAMY20028530,
BRAMY20035380, BRAMY20044920,
BRAMY20045210, BRAMY20047560,
BRAMY20050940, BRAMY20053910,
BRAMY20055760, BRAMY20072440,
BRAMY20083820, BRAMY20089770,
BRAMY20091230, BRAMY20094890,
BRAMY20096930, BRAMY20118410,
BRAMY20123400, BRAMY20125550,
BRAMY20127310, BRAMY20127760,
BRAMY20135720, BRAMY20137360,
BRAMY20139440, BRAMY20152510,
BRAMY20194680, BRAMY20204270,
BRAMY20225320, BRAMY20237190,
BRANY20245140, BRAMY20251750,
BRAMY20285650, BRAWH20020470,
BRAWH20021910, BRAWH20026010,
BRAWH20030000, BRAWH20039640,
BRAWH20055330, BRAWH20078620,
BRAWH20093070, BRAWH20185270,
BRCAN10000760, BRCAN10001680,
BRCAN20001480, BRCAN20004180,
BRCAN20005230, BRCOC20000470,
BRCOC20003600, BRHIP10000720,
BRHIP10001040, BRHIP20000210,
BRSSN20001970, BRSSN20074640,
BRSSN20091190, CD34C20001750,
CTONG20017490, CTONG20036990,
CTONG20041260, CTONG20044870,
CTONG20045500, CTONG20049480,
CTONG20051450, CTONG20055850,
CTONG20056150, CTONG20059130,
CTONG20060040, CTONG20063770,
CTONG20065680, CTONG20068360,
CTONG20069320, CTONG20071680,
CTONG20076810, CTONG20078340,
CTONG20079590, CTONG20083980,
CTONG20084020, CTONG20085210,
CTONG20167750, CTONG20168240,
CTONG20179890, CTONG20183830,
CTONG20184830, DFNES20018000,
DFNES20029660, DFNES20057660,
DFNES20072990, DFNES20080880,
FCBBF20018680, FCBBF20029280,
FCBBF20032930, FCBBF20036360,
FCBBF20054390, FCBBF30004340,
FCBBF30022680, FCBBF30029250,
FCBBF30042610, FCBBF30062490,
FCBBF30075970, FCBBF30078600,
FCBBF30091520, FCBBF30095410,
FCBBF30105440, FCBBF30118670,
FCBBF30132660, FCBBF30135890,
FCBBF30145670, FCBBF30164510,
FCBBF30169870, FCBBF30171230,
FCBBF30172330, FCBBF30177290,
FCBBF30179740, FCBBF30195690,
FCBBF30197840, FCBBF30212210,
FCBBF30223110, FCBBF30223210,
FCBBF30225930, FCBBF30230610,
FCBBF30260480, FCBBF30266510,
FCBBF30287940, FCBBF50000610,
FCBBF50004950, FEBRA20007820,
FEBRA20018670, FEBRA20031280,
FEBRA20031810, FEBRA20038220,
FEBRA20039260, FEBRA20040230,
FEBPA20040560, FEBRA20046280,
FEBRA20080860, FEBRA20084750,
FEBRA20088810, FEBRA20115930,
FEBRA20116650, FEBRA20121950,
FEBRA20141980, FEBRA20177800,
FEBRA20182030, FEBRA20191720,
HCHON10001660, HCHON20015050,
HEART10001490, HEART20031680,
HHDPC10001140, HHDPC20051850,
HHDPC20082790, HHDPC20088160,
HLUNG20015070, HLUNG20015180,
HLUNG20020850, HLUNG20029490,
HLUNG20032460, HLUNG20033350,
HLUNG20034970, HLUNG20037160,
HLUNG20041540, HLUNG20042730,
HLUNG20050760, HLUNG20052300,
HLUNG20060670, HLUNG20065990,
HLUNG20074330, HLUNG20081390,
HLUNG20088750, HLUNG20092530,
KIDNE20016360, KIDNE20083150,
KIDNE20084030, KIDNE20084040,
KIDNE20084800, KIDNE20086490,
KIDNE20086660, KIDNE20094670,
KIDNE20134130, KIDNE20142900,
KIDNE20143200, KIDNE20148080,
KIDNE20160960, KIDNE20163710,
KIDNE20169180, KIDNE20182540,
KIDNE20186170, KIDNE20188630,
KIDNE20189960, LIVER20007750,
LIVER20010510, LIVER20010990,
LIVER20026440, LIVER20030650,
LIVER20038000, MESAN20007110,
MESAN20008150, MESAN20021220,
MESAN20027900, MESAN20058110,
MESAN20059570, MESAN20060430,
MESAN20067430, MESAN20084150,
MESAN20095220, NT2NE20018740,
NT2NE20021860, NT2NE20039210,
NT2NE20053230, NT2NE20059210,
NT2NE20064780, NT2NE20069580,
NT2NE20080770, NT2NE20082130,
NT2NE20092950, NT2NE20140130,

-continued

NT2NE20145250, NT2NE20146510,
NT2NE20152620, NT2NE20167660,
NT2NE20181800, NT2RI20016240,
NT2RI20021200, NT2RI20033920,
NT2RP70003110, NT2RP70027790,
NT2RP70031070, NT2RP70031480,
NT2RP70056690, NT2RP70087140,
NTONG20034540, NTONG20053630,
OCBBF20000740, OCBBF20012520,
OCBBF20109780, OCBBF20110210,
OCBBF20110730, OCBBF20112280,
OCBBF20118720, OCBBF20120010,
OCBBF20123200, OCBBF20155030,
OCBBF20165900, OCBBF20165910,
OCBBF20170350, OCBBF20176650,
OCBBF20185630, OCBBF20191950,
PANCR10000860, PEBLM20001800,
PLACE50001290, PLACE60004260,
PLACE60006300, PLACE60053280,
PLACE60055590, PLACE60056910,
PLACE60057860, PLACE60061370,
PLACE60064740, PLACE60070500,
PLACE60087680, PLACE60104630,
PLACE60107010, PLACE60113340,
PLACE60138840, PLACE60154450,
PLACE60184870, PROST10001100,
PROST20011160, PROST20014150,
PROST20035830, PROST20045700,
PROST20050390, PROST20065100,
PROST20073280, PROST20082430,
PROST20084680, PROST20084720,
PROST20099090, PROST20105450,
PROST20106060, PROST20108850,
PROST20110120, PROST20114100,
PROST20146590, PROST20152510,
PROST20168600, PUAEN10000870,
SKMUS20006790, SKMUS20020770,
SKMUS20073150, SKMUS20091900,
SKNMC20006350, SKNSH20094350,
SMINT20006090, SMINT20008110,
SMINT20024140, SMINT20028840,
SMINT20045470, SMINT20077960,
SMINT20081330, SMINT20086250,
SMINT20088440, SMINT20088690,
SMINT20092160, SPLEN20015100,
SPLEN20017610, SPLEN20017810,
SPLEN20024190, SPLEN20024620,
SPLEN20054500, SPLEN20058180,
SPLEN20063890, SPLEN20073880,
SPLEN20080070, SPLEN20090880,
SPLEN20101950, SPLEN20104690,
SPLEN20105100, SPLEN20108000,
SPLEN20110180, SPLEN20110860,
SPLEN20118050, SPLEN20121790,
SPLEN20125230, SPLEN20136700,
S2LEN20138600, SPLEN20139100,
SPLEN20175920, SPLEN20177400,
SPLEN20182850, SPLEN20183020,
SPLEN20183950, SPLEN20190080,
SPLEN20190770, SPLEN20193230,
SPLEN20193490, SPLEN20193790,
SPLEN20201830, SPLEN20204670,
TESOP10000350, TESTI10000190,
TESTI20006160, TESTI20029100,
TESTI20031310, TESTI20032770,
TESTI20038240, TESTI20043130,
TESTI20043220, TESTI20045390,
TESTI20046540, TESTI20046870,
TESTI20047370, TESTI20050400,
TESTI20051200, TESTI20051730,
TESTI20053260, TESTI20053780,
TESTI20057200, TESTI20057590,
TESTI20059080, TESTI20061200,
TESTI20062120, TESTI20063330,
TESTI20063410, TESTI20063600,
TESTI20066330, TESTI20068530,
TESTI20070400, TESTI20070740,
TESTI20073460, TESTI20086840,
TESTI20095200, TESTI20095440,

-continued

TESTI20095880, TESTI20100090,
TESTI20102390, TESTI20105910,
TESTI20113940, TESTI20116120,
TESTI20121040, TESTI20121710,
TESTI20131440, TESTI20142540,
TESTI20149880, TESTI20151800,
TESTI20162780, TESTI20170170,
TESTI20173050, TESTI20182760,
TESTI20183680, TESTI20184750,
TESTI20186110, TESTI20198540,
TESTI20199110, TESTI20202830,
TESTI20204260, TESTI20210030,
TESTI20214630, TESTI20219110,
TESTI20244730, TESTI20245600,
TESTI20245860, TESTI20246410,
TESTI20251610, TESTI20257910,
TESTI20260640, TESTI20261040,
TESTI20262150, TESTI20262940,
TESTI20264910, TESTI20271790,
TESTI20278280, TESTI20282420,
TESTI20282900, TESTI20286590,
THYMU20007020, THYMU20012020,
THYMU20017270, THYMU20020800,
THYMU20025480, THYMU20028150,
THYMU20030690, THYMU20034790,
THYMU20046350, THYMU20046770,
THYMU20050010, THYMU20052830,
THYMU20054800, THYMU20055740,
THYMU20055760, THYMU20062770,
THYMU20078240, THYMU20079690,
THYMU20083390, THYMU20087270,
THYMU20100940, THYMU20115380,
THYMU20137050, THYMU20137570,
THYMU20143230, THYMU20150190,
THYMU20153210, THYMU20154790,
THYMU20163600, THYMU20171580,
THYMU20178440, THYMU20185470,
TRACH20011010, TRACH20011540,
TRACH20021380, TRACH20073990,
TRACH20081270, TRACH20090060,
TRACH20149720, TRACH20149740,
TRACH20159390, TRACH20163470,
TRACH20165330, TRACH20167090,
TRACH20173680, TRACH20190460,
UMVEN10001380, UTERU20035770,
UTERU20040150, UTERU20045200,
UTERU20064120, UTERU20086530,
UTERU20087070, UTERU20087850,
UTERU20089300, UTERU20089620,
UTERU20095100, UTERU20099040,
UTERU20103200, UTERU20125810,
UTERU20127030, UTERU20127150,
UTERU20139760, UTERU20188840

The clones predicted to belong to the category of glycoprotein-related protein are the following 121 clones.

ADRGL20020290, ADRGL20036840,
ADRGL20059610, ADRGL20066770,
ASTRO20055570, BNGH420046790,
BNGH420077980, BRACE20051930,
BRACE20069000, BRACE20204670,
BRACE20216950, BRAMY20013670,
BRAMY20089770, BRAMY20251210,
BRAWH20039640, BRCAN10000760,
BRCAN20005230, BRCOC20003600,
CD34C20001750, CTONG20017490,
CTONG20036990, CTONG20045500,
CTONG20059130, CTONG20079590,
CTONG20085210, CTONG20184830,
DFNES20018000, DFNES20080880,
FCBBF30004340, FCBBF30029250,
FCBBF30062490, FCBBF30091520,
FCBBF30164510, FCBBF30171230,

FCBBF30195690, FCBBF30223210,
FEBRA20038220, HCHON20015050,
HLUNG20015070, HLUNG20032460,
HLUNG20037160, HLUNG20041540,
KIDNE20142900, KIDNE20169180,
KIDNE20186170, KIDNE20189960,
MESAN20021220, MESAN20058110,
NT2NE20064780, NT2NE20140130,
NT2NE20155650, NT2RP70056690,
NTONG20053630, OCBBF20000740,
OCBBF20012520, OCBBF20110210,
OCBBF20120010, OCBBF20165900,
OCBBF20165910, OCBBF20191950,
PEBLM20001800, PLACE60004260,
PLACE60087680, PLACE60113340,
PLACE60184870, PROST20033240,
PROST20099090, PROST20108850,
PROST20146590, SKMUS20073150,
SKNMC20006350, SMINT20028840,
SMINT20056230, SMINT20083290,
SMINT20091190, SPLEN20024620,
SPLEN20063890, SPLEN20080070,
SPLEN20090880, SPLEN20118050,
SPLEN20139100, SPLEN20183020,
SPLEN20201830, TESTI10000190,
TESTI20031310, TESTI20043990,
TESTI20045390, TESTI20051200,
TESTI20057590, TESTI20059080,
TESTI20066330, TESTI20086840,
TESTI20100090, TESTI20105910,
TESTI20154370, TESTI20164210,
TESTI20182760, TESTI20184750,
TESTI20199110, TESTI20219110,
TESTI20220230, TESTI20245600,
TESTI20251610, TESTI20257910,
TESTI20286590, THYMU20024500,
THYMU20028150, THYMU20052830,
THYMU20062770, THYMU20099060,
THYMU20170080, THYMU20178440,
TRACH20011010, TRACH20011540,
TRACH20021380, TRACH20149740,
TRACH20170860, TRACH20190460,
UTERU20086530, UTERU20087070,
UTERU20127030

The clones predicted to belong to the category of signal transduction-related protein are the following 88 clones.

ASTRO20050810, ASTRO20052420,
ASTRO20085080, ASTRO20090680,
BNGH420008150, BNGH420015760,
BNGH420035290, BNGH420086030,
BRAMY20035830, BRAMY20043630,
BRAMY20118490, BRAMY20206340,
BRAMY20244490, BRAMY20251210,
BRAMY20263000, BRAWH20093040,
BRAWH20190550, CTONG20004520,
CTONG20029030, CTONG20030280,
CTONG20063930, CTONG20070720,
CTONG20189000, FCBBF30001100,
FCBBF30076310, FCBBF30100080,
FCBBF30143550, FCBBF30153170,
FCBBF30175350, FCBBF30250980,
FEBRA20090160, FEBRA20173330,
HCHON20000870, HLUNG20011260,
HLUNG20084790, KIDNE20089170,
KIDNE20160360, LIVER20011640,
MESAN20021130, MESAN20027240,
MESAN20065990, NT2NE20018890,
NT2NE20042550, NT2RP70075800,
NTONG20043080, NTONG20048440,
PLACE60071800, PROST20033240,
PROST20052850, PROST20065790,
PROST20075280, SKNSH20052400,
SKNSH20057920, SMINT20006020,
SMINT20035050, SPLEN20023540,
SPLEN20039180, SPLEN20048800,
SPLEN20049840, SPLEN20054160,
SPLEN20085910, SPLEN20191020,
SPLEN20198390, TESTI20046490,
TESTI20049060, TESTI20053070,
TESTI20066650, TESTI20081890,
TESTI20095770, TESTI20106820,
TESTI20112860, TESTI20145780,
TESTI20150420, TESTI20168880,
TESTI20205250, TESTI20228120,
TESTI20244220, TESTI20244460,
TESTI20251740, TESTI20261160,
TESTI20264530, THYMU20013250,
THYMU20039320, THYMU20106990,
THYMU20145990, THYMU20170080,
THYMU20176010, TRACH20188350

The clones predicted to belong to the category of transcription-related protein are the following 143 clones.

ASTRO20038400, ASTRO20075150,
BNGH420070370, BNGH420074600,
BNGH420087430, BRACE20003310,
BRACE20061620, BRAMY20001510,
BRAMY20040580, BRAMY20076100,
BRAMY20111780, BRAWH20040680,
BRAWH20050740, BRAWH20080580,
BRAWH20082920, BRAWH20095900,
BRSSN20066440, CTONG20020950,
CTONG20044230, CTONG20053990,
CTONG20072930, CTONG20074000,
CTONG20084660, CTONG20186370,
CTONG20186520, DFNES20028170,
DFNES20046840, DFNES20073320,
FCBBF30003610, FCBBF30019140,
FCBBF30021900, FCBBF30093170,
FCBBF30114850, FCBBF30129010,
FCBBF30136230, FCBBF30143550,
FCBBF30220050, FCBBF30228940,
FCBBF30263080, FCBBF30285930,
FCBBF50003530, FEBRA20026820,
FEBRA20027070, FEBRA20046510,
FEBRA20057010, FEBRA20063720,
FEBRA20170240, HCHON10000150,
HCHON20002650, HEART20019310,
HLUNG20014590, HLUNG20028110,
HLUNG20063700, KIDNE20140870,
LIVER20006260, MESAN20016270,
MESAN20038520, NT2NE20038870,
NT2NE20053950, NT2NE20060750,
NT2NE20061030, NT2NE20079670,
NT2NE20082600, NT2RP70001120,
NT2RP70029780, NT2RP70046410,
NT2RP70057500, NT2RP70075300,
NT2RP70090870, OCBBF20116250,
OCBBF20120950, OCBBF20121910,
OCBBF20156450, OCBBF20157970,
OCBBF20166900, OCBBF20175360,
OCBBF20177540, PEBLM20003260,
PLACE60052940, PLACE60066970,
PLACE60122970, PLACE60150510,
PLACE60177880, PROST20007170,
PROST20024250, PROST20035170,
PROST20127450, PROST20151370,
PROST20155370, PUAEN10000650,
PUAEN20003120, SMINT20011950,
SMINT20026200, SMINT20030740,
SMINT20039050, SMINT20044140,
SMINT20086720, SPLEN20042200,
SPLEN20043680, SPLEN20055600,
SPLEN20059270, SPLEN20063250,
SPLEN20098030, SPLEN20197930,

-continued

TESTI10001570, TESTI20057430,
TESTI20057840, TESTI20059810,
TESTI20067480, TESTI20068790,
TESTI20075240, TESTI20079220,
TESTI20088840, TESTI20104090,
TESTI20122070, TESTI20166670,
TESTI20171070, TESTI20173960,
TESTI20184760, TESTI20194880,
TESTI20197600, TESTI20228740,
TESTI20254030, TESTI20254990,
TESTI20266050, TESTI20274960,
TESTI20282530, THYMU10004280,
THYMU20019260, THYMU20032820,
THYMU20071120, THYMU20077250,
TKIDN10001920, UTERU20016580,
UTERU20026620, UTERU20041630,
UTERU20094830, UTERU20099510,
UTERU20101150, UTERU20169020,
UTERU20177150, UTERU20185220,
UTERU20188670

The clones predicted to belong to the category of disease-related protein are the following 331 clones.

ADRGL20020290, ADRGL20021910,
ADRGL20026790, ADRGL20036840,
ADRGL20059610, ADRGL20066770,
ASTRO20038400, ASTRO20052420,
ASTRO20055570, ASTRO20075150,
ASTRO20088950, BNGH420008150,
BNGH420086030, BRACE10000510,
BRACE20003310, BRACE20069000,
BRACE20097540, BRACE20194670,
BRACE20196180, BRACE20204670,
BRACE20216950, BRAMY20003540,
BRAMY20005080, BRAMY20035830,
BRAMY20040580, BRAMY20043630,
BRAMY20044920, BRAMY20051820,
BRAMY20056620, BRAMY20089770,
BRAMY20111780, BRAMY20152510,
BRAMY20190550, BRAMY20221600,
BRAMY20227860, BRAMY20274510,
BRAWH20082920, BRAWH20093040,
BRAWH20095900, BRAWH20190530,
BRAWH20191980, BRCAN10000760,
BRCAN10001050, BRCAN20005230,
BRSSN20066440, CTONG20004520,
CTONG20029030, CTONG20042640,
CTONG20045500, CTONG20052780,
CTONG20053990, CTONG20070780,
CTONG20070910, CTONG20072930,
CTONG20083980, CTONG20084660,
CTONG20165750, CTONG20169040,
CTONG20183430, CTONG20183830,
CTONG20186290, CTONG20189000,
DFNES20016470, DFNES20025500,
DFNES20046840, DFNES20055400,
DFNES20080880, FCBBF10000230,
FCBBF20035490, FCBBF20066340,
FCBBF30002270, FCBBF30002280,
FCBBF30019140, FCBBF30053300,
FCBBF30071500, FCBBF30072440,
FCBBF30076310, FCBBF30080730,
FCBBF30100080, FCBBF30115920,
FCBBF30118670, FCBBF30129010,
FCBBF30132050, FCBBF30136230,
FCBBF30153170, FCBBF30164510,
FCBBF30166220, FCBBF30171230,
FCBBF30175350, FCBBF30194550,
FCBBF30220050, FCBBF30223210,
FCBBF30259050, FCBBF30263080,
FCBBF30275590, FCBBF50001650,
FEBRA20027070, FEBRA20045380,
FEBRA20046200, FEBRA20046510,

-continued

FEBRA20057010, FEBRA20063720,
FEBRA20078800, FEBRA20087550,
FEBRA20088810, FEBRA20090160,
FEBRA20092760, FEBRA20151750,
FEBRA20170240, FEBRA20173330,
FEBRA20191720, HCHON10000150,
HCH0N20015050, HEART20009590,
HEART20022200, HEART20063100,
HHDPC20081230, HLUNG20008460,
HLUNG20014590, HLUNG20032460,
HLUNG20063700, HLUNG20065990,
HLUNG20069350, HLUNG20081530,
HLUNG20082350, HLUNG20083330,
HLUNG20085210, KIDNE20081170,
KIDNE20084040, KIDNE20088240,
KIDNE20089870, KIDNE20133460,
KIDNE20134890, KIDNE20141700,
KIDNE20142900, KIDNE20150730,
KIDNE20152440, KIDNE20160360,
KIDNE20165390, KIDNE20169180,
KIDNE20173430, KIDNE20189960,
LIVER20026440, MESAN20006200,
MESAN20021130, MESAN20033220,
MESAN20056890, MESAN20057240,
MESAN20065990, MESAN20067430,
MESAN20069530, NESOP20004520,
NT2NE20018890, NT2NE20026200,
NT2NE20037050, NT2NE20053950,
NT2NE20061030, NT2NE20111190,
NT2NE20117580, NT2NE20119980,
NT2NE20140130, NT2NE20141040,
NT2R120093010, NT2RP70003110,
NT2RP70046410, NT2RP70075300,
NTONG20032100, NTONG20034540,
OCBBF20000740, OCBBF20012520,
OCBBF20111600, OCBBF20120010,
OCBBF20156450, OCBBF20157970,
OCBBF20191950, PEBLM20001800,
PEBLM20003260, PLACE60004260,
PLACE60012620, PLACE60054230,
PLACE60054870, PLACE60062660,
PLACE60087680, PLACE60184870,
PROST20015210, PROST20024250,
PROST20036350, PROST20050390,
PROST20058860, PROST20063430,
PROST20065790, PROST20084720,
PROST20099090, PROST20120070,
PROST20127450, PROST20146590,
PROST20152510, PROST20168600,
PUAEN10000650, PUAEN20003120,
SKMUS20008730, SKMUS20017400,
SKMUS20040440, SKMUS20073590,
SKMUS20079150, SKNSH20009710,
SMINT20002320, SMINT20007470,
SMINT20008110, SMINT20011950,
SMINT20016150, SMINT20026200,
SMINT20030740, SMINT20049920,
SMINT20077960, SMINT20083290,
SMINT20086250, SMINT20089600,
SMINT20091190, SPLEN20023540,
SPLEN20024190, SPLEN20042200,
SPLEN20043680, SFLEN20055600,
SPLEN20057830, SPLEN20059270,
SPLEN20063890, SPLEN20073500,
SPLEN20080070, SPLEN20085910,
SPLEN20090880, SPLEN20098030,
SPLEN20118050, SPLEN20136730,
SPLEN20138600, SPLEN20139100,
SPLEN20139360, SPLEN20180980,
SPLEN20187490, SPLEN20193790,
SPLEN20201830, TESTI10000190,
TESTI20031310, TESTI20035790,
TESTI20041630, TESTI20049060,
TESTI20050720, TESTI20051200,
TESTI20057430, TESTI20057590,
TESTI20059080, TESTI20062120,
TESTI20067480, TESTI20071630,
TESTI20099350, TESTI20105130,
TESTI20105910, TESTI20108060,

-continued

TESTI20125920, TESTI20130530,
TESTI20131440, TESTI20134680,
TESTI20142540, TESTI20143180,
TESTI20150420, TESTI20154370,
TESTI20164210, TESTI20166670,
TESTI20168880, TESTI20171070,
TESTI20182760, TESTI20184750,
TESTI20193080, TESTI20194880,
TESTI20196970, TESTI20197600,
TESTI20201760, TESTI20207170,
TESTI20219110, TESTI20228740,
TESTI20244430, TESTI20246480,
TESTI20251740, TESTI20252690,
TESTI20254030, TESTI20257910,
TESTI20258720, TESTI20266050,
TESTI20271790, TESTI20274960,
TESTI20282530, TESTI20286590,
THYMU10004280, THYMU20006020,
THYMU20013250, THYMU20019260,
THYMU20023560, THYMU20028150,
THYMU20032820, THYMU20034400,
THYMU20055460, THYMU20063650,
THYMU20070250, THYMU20071120,
THYMU20081110, THYMU20090230,
THYMU20095920, THYMU20098350,
THYMU20099060, THYMU20120730,
THYMU20121040, THYMU20170080,
THYMU20185650, THYMU20191970,
TKIDN10000620, TKIDN10001920,
TRACH20011540, TRACH20091070,
TRACH20143710, TRACH20170860,
UTERU10001060, UTERU20026620,
UTERU20041630, UTERU20086530,
UTERU20087070, UTERU20087850,
UTERU20099510, UTERU20101150,
UTERU20104310, UTERU20127030,
UTERU20185220

In particular, hit data of the following 328 clones for Swiss-Prot, or GenBank, UniGene, or nr corresponded to genes or proteins which had been deposited in the Online Mendelian Inheritance in Man (OMIM), which is the human gene and disease database, (the OMIM Number is shown in the parenthesis after the Clone Name).
ADRGL20020290 (602193), ADRGL20021910 (605717), ADRGL20026790 (605046), ADRGL20036840 (142800), ADRGL20059610 (230800;230900;231000;231005), ADRGL20066770 (130660), ASTRO20038400 (604764), ASTRO20052420 (600888), ASTRO20055570 (176640;123400;137440;245300;600072), ASTRO20075150 (601896), ASTRO20088950 (603202;223000;223100), BNGH420008150 (600050), BNGH420086030 (118423), BRACE10000510 (148021), BRACE20003310 (603899), BRACE20069000 (204200), BRACE20097540 (604908), BRACE20194670 (314375), BRACE20196180 (605535), BRACE20204670 (176884), BRACE20216950 (158070), BRAMY20003540 (602142), BRAMY20005080 (604735), BRAMY20035830 (603524), BRAMY20040580 (604077), BRAMY20043630 (602775), BRAMY20044920 (603486), BRAMY20051820 (604567), BRAMY20056620 (210210), BRAMY20089770 (602566), BRAMY20111780 (604077), BRAMY20152510 (176879), BRAMY20190550 (600051), BRAMY20221600 (605789), BRAMY20227860 (605416), BRAMY20274510 (180475), BRAWH20082920 (603246), BRAWH20093040 (602989), BRAWH20095900 (602277), BRAWH20190530 (605208), BRAWH20191980 (239500), BRCAN10000760 (111000), BRCAN10001050 (603696), BRCAN20005230 (603268), BRSSN20066440 (603430), CTONG20004520 (603817), CTONG20029030 (602775), CTONG20042640 (103390), CTONG20045500 (106195), CTONG20052780 (605612), CTONG20053990 (602187), CTONG20070780 (118990), CTONG20070910 (604450), CTONG20072930 (314995), CTONG20083980 (601703), CTONG20084660 (600834), CTONG20165750 (182465), CTONG20169040 (148030), CTONG20183430 (106410), CTONG20183830 (600382), CTONG20186290 (100660), CTONG20189000 (600888), DFNES20016470 (605952), DFNES20025500 (604581), DFNES20046840 (602617;241850), DFNES20055400 (603456), DFNES20080880 (602273), FCBBF10000230 (602327), FCBBF20035490 (602489), FCBBF20066340 (603560), FCBBF30002270 (142708), FCBBF30002280 (176763), FCBBF30019140 (602120), FCBBF30053300 (600299), FCBBF30071500 (125485), FCBBF30072440 (604455), FCBBF30076310 (176892), FCBBF30080730 (600572), FCBBF30100080 (602488), FCBBF30115920 (603577), FCBBF30118670 (603640), FCBBF30129010 (601260), FCBBF30132050 (603018), FCBBF30136230 (189909), FCBBF30153170 (171860;171850), FCBBF30164510 (603006), FCBBF30166220 (182144), FCBBF30171230 (162151), FCBBF30175350 (602521), FCBBF30194550 (182900), FCBBF30220050 (600380), FCBBF30223210 (300022), FCBBF30263080 (194558), FCBBF30275590 (601403), FCBBF50001650 (605268), FEBRA20027070 (314995), FEBRA20045380 (602942), FEBRA20046200 (106410), FEBRA20046510 (604077), FEBRA20057010 (602187), FEBRA20063720 (603899), FEBRA20078800 (601825;256000), FEBRA20087550 (600811), FEBRA20088810 (603725), FEBRA20090160 (600137), FEBRA20092760 (602567), FEBRA20170240 (314997), FEBRA20173330 (602990), FEBRA20191720 (603895), HCHON10000150 (300163), HCHON20015050 (151510), HEART20009590 (604581), HEART20022200 (601870), HEART20063100 (602422), HHDPC20081230 (164035), HLUNG20008460 (300108), HLUNG20014590 (604077), HLUNG20032460 (176785), HLUNG20063700 (600210), HLUNG20065990 (186591), HLUNG20069350 (114212), HLUNG20081530 (162230), HLUNG20082350 (604677), HLUNG20083330 (120180), HLUNG20085210 (604464), KIDNE20081170 (604535), KIDNE20084040 (602382), KIDNE20088240 (605084), KIDNE20089870 (602922), KIDNE20133460 (605430), KIDNE20134890 (117143), KIDNE20141700 (312760), KIDNE20142900 (188040), KIDNE20150730 (179715), KIDNE20152440 (602194), KIDNE20160360 (602488), KIDNE20165390 (604649), KIDNE20169180 (191845), KIDNE20173430 (603831), KIDNE20189960 (275360), LIVER20026440 (601270), MESAN20006200 (151740), MESAN20021130 (600050), MESAN20033220 (600466), MESAN20056890 (600813), MESAN20057240 (126380), MESAN20065990 (601959), MESAN20067430 (191010), MESAN20069530 (604362), NESOP20004520 (153432), NT2NE20018890 (606031), NT2NE20026200 (277730), NT2NE20037050 (300028), NT2NE20053950 (604078), NT2NE20061030 (600834), NT2NE20111190

(602619), NT2NE20117580 (601825;256000), NT2NE20119980 (191161), NT2NE20140130 (601281), NT2NE20141040 (602917), NT2RI20093010 (172460), NT2RP70003110 (130160;194050), NT2RP70046410 (601930), NT2RP70075300 (601856), NTONG20032100 (148065;193900), NTONG20034540 (602658), OCBBF20000740 (602059), OCBBF20012520 (602059), OCBBF20111600 (147625), OCBBF20120010 (605008), OCBBF20156450 (314997), OCBBF20157970 (604077), OCBBF20191950 (192977), PEBLM20001800 (146900), PEBLM20003260 (194558), PLACE60004260 (601891), PLACE60012620 (214500), PLACE60054230 (300108), PLACE60054870 (160776), PLACE60062660 (606004), PLACE60087680 (146732), PLACE60184870 (172425), PROST20015210 (160745), PROST20024250 (604078), PROST20036350 (138295), PROST20050390 (601258), PROST20058860 (182282), PROST20063430 (603292), PROST20065790 (171840), PROST20084720 (604426), PROST20099090 (602714), PROST20120070 (602809), PROST20127450 (602960), PROST20146590 (158340;113720), PROST20152510 (603367), PROST20168600 (604415), PUAEN10000650 (602960) PUAEN20003120 (601573), SKMUS20008730 (602127), SKMUS20017400 (191030), SKMUS20040440 (604163), SKMUS20073590 (605834), SKMUS20079150 (605596), SKNSH20009710 (191030;164970), SMINT20002320 (601644), SMINT20007470 (190370), SMINT20008110 (604384), SMINT20011950 (603430), SMINT20016150 (134790), SMINT20026200 (159556), SMINT20030740 (604078), SMINT20049920 (600417), SMINT20077960 (137350;105120), SMINT20083290 (146900), SMINT20086250 (238330), SMINT20089600 (605926), SMINT20091190 (146900), SPLEN20023540 (605577), SPLEN20024190 (601548), SPLEN20042200 (604167), SPLEN20043680 (126340;234050;278730), SPLEN20055600 (194541), SPLEN20057830 (179715), SPLEN20059270 (602165), SPLEN20063890 (600245), SPLEN20073500 (603300), SPLEN20080070 (230000), SPLEN20085910 (603424), SPLEN20090880 (142800), SPLEN20098030 (601742), SPLEN20118050 (301870), SPLEN20136730 (605412), SPLEN20138600 (603728), SPLEN20139100 (147120), SPLEN20139360 (117140), SPLEN20180980 (156560), SPLEN20187490 (179838), SPLEN20193790 (147150), SPLEN20201830 (301870), TESTI10000190 (158340;113720), TESTI20031310 (107280), TESTI20035790 (601940), TESTI20049060 (603889), TESTI20050720 (245050), TESTI20051200 (602273), TESTI20057430 (194532), TESTI20057590 (601890), TESTI20059080 (604038), TESTI20062120 (604212), TESTI20067480 (602277), TESTI20071630 (602692), TESTI20099350 (160776), TESTI20105130 (310400), TESTI20105910 (601328), TESTI20108060 (600590), TESTI20125920 (601934), TESTI20130530 (146680), TESTI20131440 (114850), TESTI20134680 (117143), TESTI20142540 (137960), TESTI20143180 (117143), TESTI20150420 (602732), TESTI20154370 (600936), TESTI20164210 (602319), TESTI20166670 (142968), TESTI20168880 (151410), TESTI20171070 (604064), TESTI20182760 (601328), TESTI20184750 (150320), TESTI20193080 (602128), TESTI20194880 (602260), TESTI20196970 (601117), TESTI20197600 (604167), TESTI20201760 (602162), TESTI20207170 (480100), TESTI20219110 (601890), TESTI20228740 (604077), TESTI20244430 (182900), TESTI20246480 (601486), TESTI20251740 (602731), TESTI20252690 (601368), TESTI20254030 (602330), TESTI20257910 (142871), TESTI20258720 (182900), TESTI20266050 (109092), TESTI20271790 (604678), TESTI20274960 (194558), TESTI20282530 (604077), TESTI20286590 (147267), THYMU10004280 (602290), THYMU20006020 (601149), THYMU20013250 (601988), THYMU20019260 (603899), THYMU20023560 (142765), THYMU20028150 (190197), THYMU20032820 (604077), THYMU20034400 (604449), THYMU20055460 (133280), THYMU20063650 (180480), THYMU20070250 (277730), THYMU20071120 (603899), THYMU20081110 (602567), THYMU20090230 (602324), THYMU20095920 (605349), THYMU20098350 (148040;131760;131800;131900), THYMU20099060 (146900), THYMU20120730 (100660), THYMU20121040 (130592), THYMU20170080 (604964), THYMU20185650 (602121;124900), THYMU20191970 (604265), TKIDN10000620 (605072), TKIDN10001920 (603899), TRACH20011540 (191155), TRACH20091070 (100660), TRACH20143710 (601905), TRACH20170860 (147170), UTERU10001060 (311040), UTERU20026620 (314997), UTERU20041630 (602277), UTERU20086530 (173310), UTERU20087070 (216950), UTERU20087850 (605248), UTERU20099510 (604077), UTERU20101150 (164012), UTERU20104310 (604414), UTERU20127030 (150325), UTERU20185220 (600014)

The clones predicted to belong to the category of enzyme and/or metabolism-related protein are the following 219 clones.

ADRGL20059610, ASTRO20026320,
ASTRO20050810, ASTRO20088950,
BNGH420008150, BNGH420035290,
BNGH420074600, BRACE20050870,
BRACE20097540, BRACE20200770,
BRACE20204670, BRACE20215410,
BRAMY20003540, BRAMY20005080,
BRAMY20027990, BRAMY20028620,
BRAMY20044920, BRAMY20055760,
BRAMY20056620, BRAMY20072870,
BRAMY20093490, BRAMY20096930,
BRAMY20118490, BRAMY20125360,
BRAMY20143870, BRAMY20152510,
BRAMY20231150, BRAMY20244490,
BRAMY20251210, BRAWH20021910,
BRAWH20082920, BRAWH20093040,
BRAWH20094900, BRAWH20183170,
BRAWH20188750, BRAWH20190550,
BRAWH20191980, BRCAN20005230,
BRCOC20003600, CTONG20051100,
CTONG20070910, CTONG20076810,
CTONG20079590, CTONG20080140,
CTONG20085210, CTONG20186290,
DFNES20063460, DFNES20080880,
FCBBF20023490, FCBBF20066340,
FCBBF30004340, FCBBF30019140,
FCBBF30022680, FCBBF30029250,
FCBBF30072440, FCBBF30076310,
FCBBF30085560, FCBBF30091520,
FCBBF30107290, FCBBF30125880,
FCBBF30132050, FCBBF30143550,
FCBBF30153170, FCBBF30166220,
FCBBF30171230, FCBBF30175350,
FCBBF30236670, FCBBF30260480,
FEBRA20038220, FEBRA20040560,
FEBRA20078800, FEBRA20090160,
FEBRA20172230, FEBRA20173330,

-continued

HCHON20000870, HCHON20002710,
HEART10001490, HEART20022200,
HEART20047640, HEART20082570,
HLUNG20011260, HLUNG20032460,
HLUNG20041540, HLUNG20042730,
HLUNG20054790, KIDNE20080690,
KIDNE20083620, KIDNE20084040,
KIDNE20147170, KIDNE20152440,
KIDNE20173150, KIDNE20186170,
KIDNE20189960, LIVER20011640,
LIVER20026440, LIVER20055270,
MESAN20021130, MESAN20033220,
MESAN20038520, MESAN20057240,
MESAN20058110, MESAN20065990,
MESAN20095800, NT2NE20026200,
NT2NE20042550, NT2NE20117580,
NT2NE20127900, NT2RI20093010,
NT2RP70064570, NTONG20034540,
NTONG20043080, NTONG20053630,
NTONG20053730, NTONG20058010,
OCBBF20120010, OCBBF20167290,
OCBBF20191950, PANCR10000860,
PLACE60052940, PLACE60064180,
PLACE60073090, PLACE60095600,
PLACE60184410, PLACE60188630,
PROST20007600, PROST20033240,
PROST20036350, PROST20039300,
PROST20050390, PROST20051310,
PROST20052850, PROST20065790,
PROST20075280, PROST20084720,
PROST20099090, PROST20108850,
PROST20152510, PUAEN20001520,
PUAEN20002470, SKNMC20006350,
SKNSH20057920, SMINT20008110,
SMINT20049920, SMINT20094680,
SPLEN20023540, SPLEN20024930,
SPLEN20043680, SPLEN20048800,
SPLEN20054500, SPLEN20057900,
SPLEN20071820, SPLEN20080070,
SPLEN20085910, SPLEN20108000,
SPLEN20136730, SPLEN20180980,
TESTI20012080, TESTI20030200,
TESTI20031310, TEST120038240,
TESTI20050720, TESTI20051200,
TESTI20059080, TESTI20062120,
TESTI20066330, TESTI20076570,
TESTI20103690, TESTI20105130,
TESTI20106820, TESTI20108060,
TESTI20112860, TESTI20121040,
TESTI20130530, TESTI20131440,
TESTI20168880, TESTI20170170,
TESTI20196690, TESTI20196970,
TESTI20199110, TESTI20205250,
TESTI20212970, TESTI20222030,
TESTI20226520, TESTI20227380,
TESTI20244460, TESTI20244730,
TESTI20250630, TESTI20260640,
TESTI20262940, TESTI20264530,
TESTI20285230, THYMU20006020,
THYMU20013250, THYMU20034400,
THYMU20039320, THYMU20055460,
THYMU20055760, THYMU20063650,
THYMU20066660, THYMU20070250,
THYMU20087270, THYMU20096580,
THYMU20100940, THYMU20110720,
THYMU20120240, THYMU20120730,
THYMU20170230, TRACH20011010,
TRACH20021380, TRACH20091070,
TRACH20113020, TRACH20143710,
TRACH20164100, TRACH20190460,
UTERU20087070, UTERU20089620,
UTERU20104310, UTERU20185220,
UTERU20188670

ASTRO20090680, BRACE20079370,
BRAMY20234820, BRCAN10001050,
BRCAN20005410, CTONG20032930,
FCBBF20070950, FCBBF30002270,
FCBBF30053300, FCBBF30105860,
FCBBF30175350, FCBBF30215240,
FCBBF30275590, FEBRA20045380,
HLUNG20068120, KIDNE20134890,
KIDNE20150730, MESAN20021470,
NT2NE20077250, NT2NE20153620,
NT2RP70030840, NTONG20053910,
OCBBF20111370, OCBBF20174580,
PROST20063430, SKNMC10001230,
SMINT20028800, SPLEN20023540,
SPLEN20057830, SPLEN20139360,
TESTI20031410, TESTI20057840,
TESTI20065650, TESTI20066650,
TESTI20107320, TESTI20108060,
TESTI20114480, TESTI20134680,
TESTI20143180, TESTI20150920,
TESTI20201760, TESTI20278280,
TESTI20284260, THYMU20097920

The clones predicted to belong to the category of cytoskeleton-related protein are the following 80 clones.

ADRGL20062330, ASTRO20053430,
BGGI120000670, BRACE20079370,
BRAMY20038980, BRAMY20083330,
BRAMY20094890, CTONG20004110,
CTONG20032930, CTONG20077760,
CTONG20083980, CTONG20169040,
CTONG20183430, DFNES20018000,
FCBBF30105860, FCBBF30130410,
FCBBF30194550, FCBBF30201630,
FCBBF30271990, FEBRA20005040,
FEBRA20046200, FEBRA20099860,
HCHON20015050, HLUNG20081530,
KIDNE20081170, NT2RP70001730,
NT2RP70003110, NTONG20032100,
OCBBF20166890, OCBBF20174890,
PLACE60054870, PLACE60055590,
PLACE60071800, PLACE60118810,
PROST20015210, PROST20097840,
PROST20120070, PROST20146590,
SKMUS20007260, SKMUS20008730,
SKMUS20017400, SKMUS20073590,
SMINT20062050, SMINT20074330,
SMINT20077960, SPLEN20039180,
SPLEN20049840, SPLEN20076470,
SPLEN20182990, SPLEN20187490,
SPLEN20195710, TESTI10000190,
TESTI20041630, TESTI20057880,
TESTI20058920, TESTI20060080,
TESTI20064530, TESTI20064650,
TESTI20065650, TESTI20067440,
TESTI20071130, TESTI20099350,
TESTI20112540, TESTI20125280,
TESTI20136010, TESTI20153310,
TESTI20175370, TESTI20222460,
TESTI20244430, TESTI20254030,
TESTI20258720, THYMU20024500,
THYMU20062610, THYMU20098350,
TRACH20043360, TRACH20098510,
TRACH20149500, UTERU20089390,
UTERU20122520, UTERU20168960

The clones predicted to belong to the category of cell division and/or cell proliferation-related protein are the following 44 clones.

The clones predicted to belong to the category of nuclear protein and/or RNA synthesis-related protein are the following 70 clones.

ASTRO20026320, BRACE20050870,
BRACE20200770, BRAMY20134050,
BPAWH20063010, BRAWH20093040,
BRAWH20174330, BRAWH20176850,
CTONG20042640, FCBBF20023490,
FCBBF20035490, FCBBF20070950,
FCBBF30002270, FCBBF30048420,
FCBBF30080730, FCBBF30115920,
FCBBF30236670, FEBRA20035240,
FEBRA20092760, FEBRA20173330,
HHDPC20081230, HLUNG20011460,
HLUNG20068120, KIDNE20089870,
KIDNE20150730, MESAN20056890,
MESAN20057240, NT2NE20037050,
NT2NE20167660, NT2RP70031070,
NTONG20053730, PLACE60064180,
PLACE60095600, PROST20016760,
PROST20051310, PROST20058860,
PROST20152510, PUAEN20002470,
SKMUS20079150, SKNSH20030640,
SPLEN20023850, SPLEN20057830,
SPLEN20139360, SPLEN20190430,
TESTI20006830, TESTI20030200,
TESTI20031410, TESTI20035790,
TESTI20062120, TESTI20065650,
TESTI20081890, TESTI20150920,
TESTI20153310, TESTI20201760,
TESTI20212970, TESTI20227380,
TESTI20252740, TESTI20256560,
TESTI20260640, TESTI20270130,
TESTI20284260, TESTI20285230,
THYMU20021090, THYMU20049060,
THYMU20066660, THYMU20081110,
THYMU20090230, THYMU20120240,
UTERU10001060, UTERU20104310

The clones predicted to belong to the category of protein synthesis and/or transport-related protein are the following 20 clones.

BRAMY20038980, BRAMY20274510,
CTONG20008190, CTONG20033610,
FCBBF20018680, FEBRA20090220,
KIDNE20141700, NT2NE20167660,
NTONG20055200, PLACE60012620,
PROST20036350, PROST20062820,
SKMUS20040440, SMINT20000070,
SPLEN20180980, TESTI20055680,
TESTI20067440, TESTI20107240,
THYMU20096580, THYMU20121040

The clones predicted to belong to the category of cellular defense-related protein are the following 10 clones.

ASTRO20089600, BRAMY20117670,
FEBRA20087550, HLUNG20081390,
MESAN20057240, NTONG20031580,
PROST20007600, SPLEN20023850,
SPLEN20043680, TESTI20261680

The clones predicted to belong to the category of development and/or differentiation-related protein are the following 19 clones.

BRACE20061620, BRACE20200770,
BRAMY20013670, CTONG20017490,
CTONG20020950, HCHON10000150,
MESAN20021470, OCBBF20165910,
PROST20155370, PUAEN20002470,
TESTI20079220, TESTI20079980,
TESTI20166670, TESTI20184760,
TESTI20252690, TRACH20040390,
UTERU20089620, UTERU20094830,
UTERU20169020

The clones predicted to belong to the category of DNA-binding and/or RNA-binding protein are the following 168 clones.

ASTRO20038400, BGGI120010750,
BNGH420070370, BRACE20003310,
BRACE20061620, BRAMY20001510,
BRAMY20040580, BRAMY20076100,
BRAMY20111780, BRAMY20274510,
BRAWH20040680, BRAWH20050740,
BRAWH20063010, BRAWH20080580,
BRAWH20095900, BRAWH20174330,
BRSSN20066440, CTONG20020950,
CTONG20044230, CTONG20053990,
CTONG20072930, CTONG20074000,
CTONG20165750, CTONG20186370,
CTONG20186520, DFNES20046840,
DFNES20073320, FCBBF20035430,
FCBBF20070950, FCBBF30002270,
FCBBF30003610, FCBBF30019140,
FCBBF30021900, FCBBF30048420,
FCBBF30080730, FCBBF30093170,
FCBBF30114850, FCBBF30129010,
FCBBF30136230, FCBBF30220050,
FCBBF30228940, FCBBF30236670,
FCBBF30263080, FCBBF30285930,
FCBBF50003530, FEBRA20026820,
FEBRA20027070, FEBRA20035240,
FEBRA20046510, FEBRA20057010,
FEBRA20063720, FEBRA20087550,
FEBRA20092760, FEBRA20170240,
FEBRA20177800, HCHON20002650,
HEART20019310, HEART20063100,
HHDPC20081230, HLUNG20011460,
HLUNG20014590, HLUNG20028110,
HLUNG20063700, HLUNG20068120,
KIDNE20140870, LIVER20006260,
MESAN20016270, MESAN20056890,
MESAN20057240, NT2NE20038870,
NT2NE20053950, NT2NE20060750,
NT2NE20079670, NT2NE20082600,
NT2NE20087270, NT2RP70029780,
NT2R270046410, NT2RP70057500,
NT2RP70075300, NT2RP70090870,
OCBBF20116250, OCBBF20120950,
OCBBF20121910, OCBBF20156450,
OCBBF20157970, OCBBF20166900,
OCBBF20175360, OCBBF20177540,
PEBLM10001470, PEBLM20003260,
PLACE60066970, PLACE60122970,
PLACE60177880, PROST20007170,
PROST20024250, PROST20035170,
PROST20051310, PROST20058860,
PROST20151370, PROST20155370,
PUAEN20003120, SMINT20011950,
SMINT20030740, SMINT20039050,
SMINT20044140, SMINT20086720,
SPLEN20042200, SPLEN20043680,
SPLEN20055600, SPLEN20059270,
SPLEN20063250, SPLEN20139360,
SPLEN20190430, TESTI10001570,
TESTI20006830, TESTI20030200,

TESTI20031410, TESTI20035790,
TESTI20057430, TESTI20059810,
TESTI20062120, TESTI20067480,
TESTI20068790, TESTI20075240,
TESTI20079220, TESTI20088840,
TESTI20104090, TESTI20134970,
TESTI20166670, TESTI20171070,
TESTI20173960, TESTI20184760,
TESTI20197600, TESTI20201760,
TESTI20212970, TESTI20227380,
TESTI20228740, TESTI20246480,
TESTI20254030, TESTI20254990,
TESTI20266050, TESTI20268240,
TESTI20270130, TESTI20274960,
TESTI20282530, TESTI20284260,
TESTI20285230, THYMU10004280,
THYMU20019260, THYMU20023560,
THYMU20032820, THYMU20049060,
THYMU20066660, THYMU20071120,
THYMU20077250, THYMU20081110,
THYMU20090230, TKIDN10001920,
TRACH20108240, UTERU10001060,
UTERU20026620, UTERU20041630,
UTERU20094830, UTERU20099510,
UTERU20101150, UTERU20169020,
UTERU20177150, UTERU20188670

The clones predicted to belong to the category of ATP binding and/or GTP-binding protein are the following 93 clones.

ASTRO20026320, BNGH420035290,
BRACE20050870, BRACE20079370,
BRACE20200770, BRAMY20055760,
BRAMY20118490, BRAMY20244490,
BRAMY20251210, BRAWH20093040,
BRAWH20190550, BRCAN10001050,
BRCOC20003600, CTONG20008190,
CTONG20030280, CTONG20032930,
CTONG20176040, CTONG20184830,
FCBBF20023490, FCBBF30019140,
FCBBF30076310, FCBBF30105860,
FCBBF30175350, FCBBF30201630,
FCBBF30236670, FEBRA20005040,
FEBRA20090160, FEBRA20173330,
HCHON20000870, HLUNG20011260,
HLUNG20052300, KIDNE20081170,
KIDNE20134890, LIVER20030650,
LIVER20055270, MESAN20065990,
NT2NE20042550, NTONG20043080,
NTONG20055200, OCBBF20182060,
PLACE60054870, PLACE60064180,
PLACE60095600, PLACE60140640,
PROST20015210, PROST20033240,
PROST20036350, PROST20051310,
PROST20052850, PROST20062820,
PROST20075280, PROST20120070,
PUAEN20002470, SKNSH20052400,
SKNSH20057920, SMINT20008110,
SPLEN20023850, SPLEN20043680,
SPLEN20049840, SPLEN20136730,
SPLEN20180980, SPLEN20193790,
TESTI20055680, TESTI20058920,
TESTI20060080, TESTI20064650,
TESTI20071130, TESTI20099350,
TESTI20106820, TESTI20112860,
TESTI20134680, TESTI20136010,
TESTI20143180, TESTI20175370,
TESTI20212970, TESTI20222460,
TESTI20227380, TESTI20244220,
TESTI20244460, TESTI20264530,
THYMU20013250, THYMU20039320,
THYMU20062610, THYMU20066660,

THYMU20087270, THYMU20096580,
THYMU20100940, THYMU20176010,
TRACH20043360, TRACH20098510,
TRACH20113020, UTERU20185220,
UTERU20188670

Among the clones other than the ones shown above, BNGH420036410 and FCBBF30257370 are clones which were predicted to highly possibly belong to the category of secretory protein and/or membrane protein based on the result of domain search by Pfam.

SMINT20044730, TESTI20140970

The two clones shown above are clones which were predicted to highly possibly belong to the category of glycoprotein-related protein based on the result of domain search by Pfam.

BRACE20055560, CTONG20046690,
DFNES20043710, FCBBF30005500,
MESAN20030350, MESAN20030370,
PLACE60074820, TESTI20058350,
TESTI20106170, TRACH20131230,
UTERU20000950

The 11 clones shown above are clones which were predicted to highly possibly belong to the category of signal transduction-related protein based on the result of domain search by Pfam.

ASTRO20010290, BRACE20099070,
CTONG20007660, DFNES20076340,
DFNES20094820, FCBBF30125460,
FCBBF30142290, FCBBF30169280,
FEBRA20031000, NT2NE20026510,
NT2RP70031340, PLACE50001390,
SPLEN20135030, TESTI20046890,
TESTI20060350, TESTI20166290,
TESTI20259110, THYMU20184550

The 18 clones shown above are clones which were predicted to highly possibly belong to the category of transcription-related protein based on the result of domain search by Pfam.

ADRGL20047770, ADRGL20079060,
BRACE20014450, BRACE20051600,
BRAWH20185260, CTONG20033750,
CTONG20070090, CTONG20190290,
FCBBF20020440, FCBBF30005360,
FCBBF30173960, FEBRA20031000,
KIDNE20087880, LIVER20013890,
MESAN20030350, MESAN20030370,
OCBBF20113110, PLACE60074820,
PLACE60093380, PROST20028970,

PROST20102190, SALGL10001070,
SPLEN20006950, SPLEN20011350,
SPLEN20050090, TESTI20060830,
TESTI20066150, TESTI20120900,
TESTI20132310, TESTI20148380,
TESTI20162980, TESTI20166290,
TESTI20205100, THYMU20112590,
TRACH20029880

The 35 clones shown above are clones which were predicted to highly possibly belong to the category of enzyme and/or metabolism-related protein based on the result of domain search by Pfam.
PLACE60054820, TESTI20197030

The two clones shown above are clones which were predicted to highly possibly belong to the category of cell division and/or cell proliferation-related protein based on the result of domain search by Pfam.

ASTRO20006530, OCBBF20016390, TRACH20058000

The three clones shown above are clones which were predicted to highly possibly belong to the category of cytoskeleton-related protein based on the result of domain search by Pfam.

BRACE20065470, PLACE60054820

The two clones shown above are clones which were predicted to highly possibly belong to the category of nuclear protein and/or RNA synthesis-related protein based on the result of domain search by Pfam.

ASTRO20010290, BRACE20099070,
BRAWH20014590, CTONG20007660,
DFNES20076340, DFNES20094820,
FCBBF30125460, FCBBF30142290,
FCBBF30169280, FEBRA20031000,
MESAN20034440, NT2NE20026510,
NT2RP70031340, PLACE50001390,
SPLEN20135030, TESTI20046890,
TESTI20060350, TESTI20166290,
TESTI20259110, THYMU20104480,
THYMU20184550

The 21 clones shown above are clones which were predicted to highly possibly belong to the category of DNA-binding and/or RNA-binding protein based on the result of domain search by Pfam.
KIDNE20133880, MESAN20030350, MESAN20030370, TESTI20059480

The four clones shown above are clones which were predicted to highly possibly belong to the category of ATP-binding and/or GTP-binding protein based on the result of domain search by Pfam.

The 205 clones shown below are clones which were unassignable to any of the above-mentioned categories, but have been predicted to have some functions based on homology search for their full-length nucleotide sequences and motif search in their deduced ORFs. Clone Name, Definition in the result of homology search or Motif Name in the motif search, demarcated by a double slash mark (//), are shown below.

ADRGL20022600//DIAPHANOUS PROTEIN HOMOLOG 1 (P140MDIA).
ADRGL20023920//ABC1 PROTEIN HOMOLOG PRECURSOR.
ASTRO20001910//*Rattus norvegicus* mRNA for annexin V-binding protein (ABP-10), partial cds.
ASTRO20009140//PUTATIVE COMPETENCE-DAMAGE PROTEIN.
ASTRO20046280//PSU1 PROTEIN.
ASTRO20058960//DNA damage inducible protein homolog—fission yeast (*Schizosaccharomyces pombe*)
BNGH420024870//C2 domain//C2 domain//C2 domain
BRACE20007330//RING CANAL PROTEIN (KELCH PROTEIN).
BRACE20052430//*Homo sapiens* AMSH mRNA, complete cds.
BRACE20054600//*Xenopus laevis* mRNA for Kielin, complete cds.
BRACE20059810//TSC-22/dip/bun family
BRACE20063540//MEROZOITE SURFACE PROTEIN CMZ-8 (FRAGMENT).
BRACE20079200//*Xenopus laevis* mRNA for Kielin, complete cds.
BRAMY20016780//Proprotein convertase P-domain
BRAMY20023640//UBX domain
BRAMY20045420//Domain found in Dishevelled, Egl-10, and Pleckstrin
BRAMY20056840//UBE-1c2
BRAMY20063750//*Homo sapiens* HRIHFB2007 mRNA, partial cds.
BRAMY20102900//*Homo sapiens* RU1 (RU1) mRNA, complete cds.
BRAMY20158550//CALMODULIN.
BRAMY20223010//*Mus musculus* leucine-rich glioma-inactivated 1 protein precursor, (Lgi1) mRNA, complete cds.
BRAMY20238630//TETRATRICOPEPTIDE REPEAT PROTEIN 4.
BRAMY20245760//*Araneus diadematus* fibroin-4 mRNA, partial cds.
BRAWH20047790//HMG (high mobility group) box
BRSSN20005610//*Mus musculus* semaphorin cytoplasmic domain-associated protein 3A (Semcap3) mRNA, complete cds.
BRSSN20005660//Bacterial type II secretion system protein
BRSSN20093890//*Homo sapiens* mRNA for Kelch motif containing protein, complete cds.
CTONG20041150//*Streptomyces* ansochromogenes strain 7100 SanE (sanE) gene, complete cds.
CTONG20066110//*Homo sapiens* DEME-6 mRNA, partial cds.
CTONG20069420//Ribosomal protein S14p/S29e
CTONG20071040//BETA CRYSTALLIN B2 (BP).
CTONG20074170//DENN (AEX-3) domain
CTONG20083430//Nuclear transition protein 2
CTONG20170940//MYOTROPHIN (V-1 PROTEIN) (GRANULE CELL DIFFERENTIATION PROTEIN).
CTONG20174290//TRICHOHYALIN.
CTONG20174580//*Homo sapiens* mRNA for vascular Rab-GAP/TBC-containing protein complete cds.
CTONG20180690//Collagen triple helix repeat (20 copies)
CTONG20186550//cca3 protein—rat CTONG20188080//TPR Domain
FCBBF10004760//*Homo sapiens* GAP-like protein (N61) mRNA, complete cds.
FCBBF20033360//RING CANAL PROTEIN (KELCH PROTEIN).
FCBBF20041380//SAM domain (Sterile alpha motif)
FCBBF20043730//UBA domain
FCBBF20056580//*Mus musculus* NSD1 protein mRNA, complete cds.
FCBBF20059660//TPR Domain
FCBBF30019180//SERINE/THREONINE PROTEIN PHOSPHATASE 2A, 65 KDA REGULATORY SUBUNIT A, ALPHA ISOFORM (PP2A, SUBUNIT A, PR65-ALPHA ISOFORM) (PP2A, SUBUNIT A, R1-ALPHA ISOFORM).
FCBBF30026580//*Homo sapiens* retinoblastoma-associated protein RAP140 mRNA, complete cds.
FCBBF30035570//C2 domain
FCBBF30079770//D-isomer specific 2-hydroxyacid dehydrogenases
FCBBF30100120//*Mus musculus* semaphorin cytoplasmic domain-associated protein 3A (Semcap3) mRNA, complete cds.
FCBBF30100410//*Mus musculus* testis—specific Y-encoded-like protein (Tspy11) mRNA, complete cds.
FCBBF30118890//*Drosophila melanogaster* La related protein (larp) mRNA, partial cds.
FCBBF30138000//trg protein—rat
FCBBF30157270//*Rattus norvegicus* PAPIN mRNA, complete cds.
FCBBF30161780//gag gene protein p24 (core nucleocapsid protein)//Zinc knuckle
FCBBF30198670//dof protein—fruit fly (*Drosophila melanogaster*)
FCBBF30222910//*Mus musculus* Rap2 interacting protein 8 (RPIP8) mRNA, complete cds.
FCBBF30255680//*Rattus norvegicus* brain specific cortactin-binding protein CBP90 mRNA, partial cds.
FCBBF30260210//*Drosophila melanogaster* KISMET-L long isoform (kis) mRNA, complete cds.
FCBBF30282020//cca3 protein—rat
FCBBF40000610//late gestation lung 2 protein [*Rattus norvegicus*].
FEBRA20029620//Leucine Rich Repeat//Leucine Rich Repeat//Leucine Rich Repeat
FEBRA20031150//*Homo sapiens* HSKM-B (HSKM-B) mRNA, complete cds.
FEBRA20038330//Corticotropin-releasing factor family
FEBRA20038970//*Homo sapiens* mRNA for stabilin-1 (stab1 gene).
FEBRA20088610//CELLULAR RETINALDEHYDE-BINDING PROTEIN (CRALBP).
FEBRA20150420//HYPOTHETICAL -131.5 KDA PROTEIN C02F12.7 IN CHROMOSOME X.
FEBRA20175330//D-isomer specific 2-hydroxyacid dehydrogenases
HEART10001420//*Mus musculus* skm-BOP1 (Bop) mRNA, complete cds.
HLUNG20024050//Rubredoxin
HLUNG20030420//*Mus musculus* mRNA for MAIL, complete cds.
HLUNG20030490//*Ambystoma tigrinum* RPE65 protein mRNA, complete cds.
HLUNG20033060//*Homo sapiens* GAP-like protein (N61) mRNA, complete cds.
HLUNG20041590//ubiquitous tetratricopeptide containing protein RoXaN [*Homo sapiens*].
HLUNG20045340//MOB2 PROTEIN (MPS1 BINDER 2).
HLUNG20051330//FHIPEP family
HLUNG20070410//Dihydropyridine sensitive L-type calcium channel (Beta subunit)
HLUNG20072100//Gallus gallus Dach2 protein (Dach2) mRNA, complete cds.
HLUNG20083480//Chicken mRNA for TSC-22 variant, complete cds, clone SLFEST52.
KIDNE20027980//SAM domain (Sterile alpha motif)
KIDNE20084730//*Homo sapiens* FH1/FH2 domain-containing protein FHOS (FHOS) mRNA, complete cds.
KIDNE20149780//NG28 [*Mus musculus*]
KIDNE20154330//*Rattus norvegicus* mRNA for multi PDZ domain protein.
KIDNE20170400//Leucine Rich Repeat//Leucine Rich Repeat//Leucine Rich Repeat//Protein kinase C terminal domain//Rubredoxin
KIDNE20189890//*Homo sapiens* mRNA for KARP-1-binding protein 2 (KAB2), complete cds.
LIVER20010760//*Homo sapiens* C-type lectin-like receptor-1 mRNA, complete cds.
LIVER20040740//RETINAL-BINDING PROTEIN (RALBP).
MESAN20009090//*Homo sapiens* CEGP1 protein (CEGP1), mRNA
MESAN20026870//PAN domain//TBC domain
MESAN20090190//CEGP1 protein [*Homo sapiens*].
NT2NE20059680//*Homo sapiens* integrin cytoplasmic domain associated protein (Icap-1a) mRNA, complete cds.
NT2NE20077270//Adenovirus EB1 55K protein/large t-antigen
NT2NE20087850//ANTER-SPECIFIC PROLINE-RICH PROTEIN APG (PROTEIN CEX) (FRAGMENT).
NT2NE20095230//*Homo sapiens* HSKM-B (HSKM-B) mRNA, complete cds.
NT2NE20108420//KES1 PROTEIN.
NT2NE20173970//*Rattus norvegicus* beta-catenin binding protein mRNA, complete cds.
NT2NE20177210//*Leishmania major* partial ppg1 gene for proteophosphoglycan.
NT2RP70012830//CALPHOTIN.
NT2RP70035110//*Caenorhabditis elegans* UNC-89 (unc-89) gene, complete cds.
NTONG20002230//*Mus musculus* RW1 protein mRNA, complete cds.
NTONG20005310//Ribosomal protein S9/S16
NTONG20029850//CALCYPHOSINE (R2D5 ANTIGEN).
NTONG20035150//RING CANAL PROTEIN (KELCH PROTEIN).
NTONG20058220//*Homo sapiens* phosphoprotein pp75 mRNA, partial cds.
OCBBF20005220//*Rattus norvegicus* Fos-related antigen mRNA, complete cds. OCBBF20011860//*Mus musculus* epithelial protein lost in neoplasm-a (Eplin) mRNA, complete cds.
OCBBF20016810//enhancer of polycomb,[*Mus musculus*]
OCBBF20147070//DNA polymerase (viral) C-terminal domain
OCBBF20160380//liver stage antigen LSA-1—*Plasmodium falciparum*
OCBBF20177910//Corticotropin-releasing factor family
PEBLM20005020//Virion host shutoff protein
PLACE60055460//*Homo sapiens* leucine-zipper protein FKSG13 (FKSG13) mRNA, complete cds.
PLACE60068710//SUPPRESSOR PROTEIN SRP40.
PLACE60080360//mucin [*Homo sapiens*]

PLACE60082850//Pathogenesis-related protein Bet v I family
PLACE60098350//Human hepatocellular carcinoma associated protein (JCL-1) mRNA, complete cds.
PLACE60105680//*Homo sapiens* mRNA for TU12B1-TY, complete cds.
PLACE60119700//*Homo sapiens* mRNA for ABP32, complete cds.
PLACE60120280//SER/THR-RICH PROTEIN T10 IN DGCR REGION.
PLACE60132200//TRICHOHYALIN.
PLACE60181870//Pentaxin family
PROST20084470//*Plasmodium* berghei strain NYU2 merozoite surface protein-1 mRNA, partial cds.
PROST20087240//gag gene protein p24 (core nucleocapsid protein)
PROST20122490//Gallus gallus syndesmos mRNA, complete cds.
PROST20130320//S-100/ICaBP type calcium binding domain
PROST20152870//*Homo sapiens* APC2 gene, exon 14.
PUAEN10001640//*Mus musculus* cerebellar postnatal development protein-1 (Cpd1) mRNA, partial cds.
PUAEN20000800//Bleomycin resistance protein
SMINT20012220//Collagen triple helix repeat (20 copies)
SMINT20035510//*Drosophila melanogaster* La related protein (larp) mRNA, partial cds.
SMINT20036440//*Drosophila melanogaster* epsin-like protein mRNA, complete cds.
SMINT20038660//*Homo sapiens* HNOEL-iso (HNOEL-iso) mRNA, complete cds.
SMINT20043390//Ras association (RalGDS/AF-6) domain
SMINT20048720//Cytochrome P450//Cytochrome P450
SMINT20052130//*Rattus norvegicus* mRNA for gankyrin homologue, complete cds.
SMINT20054050//ABC1 PROTEIN HOMOLOG PRECURSOR.
SPLEN20024770//*Rattus norvegicus* (rsec6) mRNA, complete cds.
SPLEN20040780//CORNIFIN B (SMALL PROLINE-RICH PROTEIN 1B) (SPR1B) (SPR1 B).
SPLEN20041810//BC-2 protein [*Homo sapiens*]
SPLEN20100040//258.1 KDA PROTEIN C21ORF5 (KIAA0933).
SPLEN20104150//Ribosomal protein L36
SPLEN20116720//*Homo sapiens* misato mRNA, partial cds.
SPLEN20176130//*Homo sapiens* mRNA for ALEX1, complete cds.
SPLEN20181570//TRICHOHYALIN.
TESTI20004310//TRICHOHYALIN.
TESTI20016970//TPR Domain
TESTI20030440//TRICHOHYALIN.
TESTI20043180//mouse mRNA for megakaryocyte potentiating factor, complete cds.
TESTI20043910//IQ calmodulin-binding motif//IQ calmodulin-binding motif//IQ calmodulin-binding motif//IQ calmodulin-binding motif//IQ calmodulin-binding motif
TESTI20044900//*Strongylocentrotus purpuratus* radial spokehead mRNA, complete cds.
TESTI20046110//Extracellular link domain
TESTI20047930//*Homo sapiens* NY-REN-2 antigen mRNA, complete cds.
TESTI20049410//Proprotein convertase P-domain
TESTI20053950//IQ calmodulin-binding motif
TESTI20054700//*Streptococcus pneumoniae* strain g375 surface protein PspC (pSpC) gene, pspC-8.1 allele, complete cds.
TESTI20055880//Serum amyloid A protein
TESTI20056030//*Homo sapiens* 88-kDa Golgi protein (GM88) mRNA, complete cds.
TESTI20061090//Keratin, high sulfur B2 protein
TESTI20064370//TPR Domain//TPR Domain//TPR Domain//TPR Domain//Synaptobrevin
TESTI20084250//OXYSTEROL-BINDING PROTEIN.
TESTI20092170//ENV polyprotein (coat polyprotein)
TESTI20116050//UBX domain
TESTI20120500//Kelch motif//Kelch motif
TESTI20126280//*Mus musculus* STAP mRNA for sperm tail associated protein, complete cds.
TESTI20144390//TESTIS-SPECIFIC PROTEIN PBS13.
TESTI20165990//Ribosomal protein L36
TESTI20169500//HYPOTHETICAL 51.9 KDA PROTEIN C27F1.04C IN CHROMOSOME I.
TESTI20170280//Flagellar L-ring protein
TESTI20176450//thioredoxin interacting factor [*Mus musculus*].
TESTI20179230//Dihydropyridine sensitive L-type calcium channel (Beta subunit)
TESTI20180600//*Homo sapiens* HOM-TES-85 tumor antigen mRNA, complete cds.
TESTI20209050//HYPOTHETICAL 113.1 KDA PROTEIN IN PRE5-FET4 INTERGENIC REGION.
TESTI20210570//RETINAL-BINDING PROTEIN (RALBP).
TESTI20215310//*Homo sapiens* calcyclin binding protein mRNA, complete cds.
TESTI20247440//Human BLu protein testis isoform (BLu) mRNA, complete cds.
TESTI20249360//*Homo sapiens* DEME-6 mRNA, partial cds.
TESTI20250220//TRICHOHYALIN.
TESTI20251440//*Rattus norvegicus* (rsec6) mRNA, complete cds.
TESTI20255460//*Mus musculus* mRNA for MIWI (piwi), complete cds.
THYMU20009500//TPR Domain
THYMU20010180//MOB1 PROTEIN (MPS1 BINDER 1).
THYMU20013810//Human SEC7 homolog Tic (TIC) mRNA, complete cds.
THYMU20018250//TPR Domain
THYMU20026950//*Mus musculus* ROSA 26 transcription AS ROSA26AS mRNA, complete cds.
THYMU20028410//*Mus musculus* Pax transcription activation domain interacting protein PTIP mRNA, complete cds.
THYMU20030460//*Homo sapiens* tumor endothelial marker 7 precursor (TEM7) mRNA, complete cds.
THYMU20031330//*Homo sapiens* putative nucleotide binding protein mRNA, complete cds.
THYMU20052460//PHORBOLIN I (FRAGMENTS).
THYMU20055450//Zona pellucida-like domain
THYMU20083830//*Homo sapiens* angiostatin binding protein 1 mRNA, complete cds.
THYMU20139160//Uncharacterized protein family UPF0031
THYMU20151610//*Homo sapiens* antigen NY—CO-1 (NY—CO-1) mRNA, complete cds.
TRACH20093400//TRICHOHYALIN.
TRACH20104510//Uncharacterized protein family UPF0005
TRACH20122980//HYPOTHETICAL PROTEIN MJ0798.
TRACH20139280//PX domain
TRACH20164810//D-isomer specific 2-hydroxyacid dehydrogenases TRACH20165540//Human alpha-i type I collagen gene surrounding osteogenesis imperfecta OI type II deletion.
UTERU20051790//guanylate kinase-interacting protein 1 Maguin-1, membrane-associated—rat
UTERU20083020//Domain of unknown function DUF71
UTERU20121140//Rhodanese-like domain
UTERU20128560//26.4 KDA PROTEIN IN RUVC-ASPS INTERGENIC REGION.
UTERU20132620//AXONEME-ASSOCIATED PROTEIN MST101(2).
UTERU20134830//pellino (*Drosophila*) homolog 2 [*Homo sapiens*]
UTERU20181270//Zinc knuckle With respect to the remaining 613 clones, there are so far no information available for estimating their functions. However, there is the possibility that the functions of these clones will be revealed in future. Their Clone Names are indicated below.

ADRGL20027530, ADRGL20040310, ADRGL20040770, ADRGL20046760, ADRGL20047080, ADRGL20057560, ADRGL20067320, ADRGL20095330, ASTRO20003720, ASTRO20004820, ASTRO20012270, ASTRO20020350, ASTRO20022020, ASTRO20027330, ASTRO20047510, ASTRO20069200, ASTRO20076660, ASTRO20091770, ASTRO20141740, BNGH410000570, BNGH420014060, BNGH420040760, BNGH420042910, BNGH420045380, BNGH420061350, BNGH420062340, BNGH420085100, BRACE20009050, BRACE20017790, BRACE20018810, BRACE20025820, BRACE20038920, BRACE20054480, BRACE20057870, BRACE20059110, BRACE20062580, BRACE20069440, BRACE20098860, BRACE20196960, BRACE20200970, BRACE20205840, BRACE20207420, BRACE20212450, BRACE20216700, BRACE20219360, BRAMY10000980, BRAMY20000210, BRAMY20000250, BRAMY20020440, BRAMY20021580, BRAMY20023390, BRAMY20036530, BRAMY20036810, BRAMY20039290, BRAMY20043520, BRAMY20050640, BRAMY20052440, BRAMY20073080, BRAMY20074110, BRAMY20074860, BRAMY20076130, BRAMY20076530, BRAMY20095080, BRAMY20095570, BRAMY20100680, BRAMY20107980, BRAMY20120170, BRAMY20124970, BRAMY20125170, BRAMY20126910, BRAMY20139750, BRAMY20155500, BRAMY20159250, BRAMY20160020, BRAMY20173480, BRAMY20219620, BRAMY20225250, BRAMY20227230, BRAMY20227960, BRAMY20243120, BRAMY20245350, BRAMY20267780, BRAMY20269040, BRAMY20271140, BRAMY20287400, BRAWH20020600, BRAWH20025490, BRAWH20027250, BRAWH20055240, BRAWH20055780, BRAWH20058120, BRAWH20078080, BRAWH20082550, BRAWH20173790, BRAWH20175230, BRAWH20175340, BRAWH20182670, BRAWH20186010, BRCOC10000400, BRH1P20003590, BRHIP20005060, BRSSN20092440, CTONG10000090, CTONG20000340, CTONG20002790, CTONG20008460, CTONG20015240, CTONG20020660, CTONG20027660, CTONG20031150, CTONG20031890, CTONG20033500, CTONG20035240, CTONG20036800, CTONG20039370, CTONG20050490, CTONG20055670, CTONG20057750, CTONG20057950, CTONG20061290, CTONG20062730, CTONG20065240, CTONG20073990, CTONG20074740, CTONG20076230, CTONG20081840, CTONG20133720, CTONG20165590, CTONG20166580, CTONG20168460, CTONG20169530, CTONG20174440, CTONG20179390, CTONG20179980, CTONG20180620, CTONG20181350, CTONG20184130, CTONG20186140, CTONG20190630, DFNES20032550, DFNES20088810, FCBBF10002200, FCBBF20021110, FCBBF20028980, FCBBF20038230, FCBBF20038950, FCBBF20061310, FCBBF20070800, FCBBF30000010, FCBBF30001020, FCBBF30001150, FCBBF30002330, FCBBF30004730, FCBBF30005180, FCBBF30019240, FCBBF30056980, FCBBF30063990, FCBBF30068210, FCBBF30072480, FCBBF30074530, FCBBF30074620, FCBBF30081000, FCBBF30088700, FCBBF30089380, FCBBF30091010, FCBBF30099490, FCBBF30101240, FCBBF30101300, FCBBF30105080, FCBBF30106950, FCBBF30107330, FCBBF30114180, FCBBF30115230, FCBBF30128420, FCBBF30130580, FCBBF30151190, FCBBF30170710, FCBBF30179180, FCBBF30181730, FCBBF30194370, FCBBF30195700, FCBBF40001920, FCBBF40005000, FCBBF50000410, FEBRA20035200, FEBRA20039070, FEBRA20040260, FEBRA20040290, FEBRA20076200, FEBPA20078180, FEBRA20082660, FEBRA20083410, FEBRA20086600, FEBRA20091620, FEBRA20093270, FEBPA20093280, FEBRA20095410, FEBRA20098040, FEBRA20101410, FEBRA20108020, FEBRA20108580, FEBRA20121200, FEBRA20163980, FEBRA20175020, FEBRA20180510, FEBRA20187460, HHDPC20082970, HLUNG20009260, HLUNG20009550, HLUNG20010130, HLUNG20011440, HLUNG20012140, HLUNG20020500, HLUNG20021450, HLUNG20023030, HLUNG20025620, HLUNG20029420, HLUNG20030610, HLUNG20031620, HLUNG20033310, HLUNG20037140, HLUNG20037780, HLUNG20038330, HLUNG20047070, HLUNG20055240, HLUNG20056560, HLUNG20057380, HLUNG20059240, HLUNG20065700, HLUNG20067810, HLUNG20072190, HLUNG20072450, HLUNG20079310, HLUNG20083840, HLUNG20083960, HLUNG20093030, HLUNG20094130, KIDNE20011600, KIDNE20024380, KIDNE20086970, KIDNE20091090, KIDNE20094260, KIDNE20095530, KIDNE20137310, KIDNE20138450, KIDNE20141120, KIDNE20142680, KIDNE20154830, KIDNE20155980, KIDNE20157100, KIDNE20176030, KIDNE20181670, KIDNE20191870, LIVER20007690, LIVER20032340, MESAN20008940, MESAN20021860, MESAN20029780, MESAN20030390, MESAN20041380, MESAN20045750, MESAN20060220, MESAN20085360, MESAN20089260, MESAN20094180, NESOP20005040, NT2NE20028700, NT2NE20033150, NT2NE20045190, NT2NE20047870,

-continued

NT2NE20062880, NT2NE20066590,
NT2NE20070520, NT2NE20073650,
NT2NE20077860, NT2NE20086070,
NT2NE20088030, NT2NE20104000,
NT2NE20107810, NT2NE20112210,
NT2NE20114850, NT2NE20121610,
NT2NE20124570, NT2NE20126030,
NT2NE20140280, NT2NE20148690,
NT2NE20149500, NT2NE20150610,
NT2NE20157120, NT2NE20165190,
NT2NE20181760, NT2NE20184720,
NT2RP70022820, NT2RP70049610,
NT2RP70056290, NT2RP70074800,
NT2RP70080150, NT2RP70084540,
NTONG20017620, NTONG20049180,
OCBBF20001780, OCBBF20009820,
OCBBF20109450, OCBBF20112320,
OCBBF20115360, OCBBF20117220,
OCBBF20119810, OCBBF20142290,
OCBBF20152330, OCBBF20188280,
PLACE60001910, PLACE60011180,
PLACE60017120, PLACE60055350,
PLACE60062870, PLACE60063940,
PLACE60069880, PLACE60072390,
PLACE60072420, PLACE60077870,
PLACE60081260, PLACE60088240,
PLACE60092280, PLACE60092370,
PLACE60095240, PLACE60109910,
PLACE60132320, PLACE60132880,
PLACE60155910, PLACE60157310,
PLACE60162100, PLACE60175640,
PLACE60177910, PROST10001360,
PROST10002150, PROST20011800,
PROST20014140, PROST20014650,
PROST20015400, PROST20022120,
PROST20036280, PROST20041460,
PROST20042700, PROST20047440,
PROST20048170, PROST20052720,
PROST20054660, PROST20060200,
PROST20078710, PROST20093470,
PROST20094000, PROST20097310,
PROST20097360, PROST20102500,
PROST20103820, PROST20121570,
PROST20124000, PROST20125420,
PROST20138730, PROST20156360,
PROST20159320, SKMUS20026340,
SKMUS20064810, SKNSH10001010,
SKNSH20007160, SKNSH20040390,
SKNSH20068220, SMINT20011830,
SMINT20013970, SMINT20014610,
SMINT20017310, SMINT20021260,
SMINT20023110, SMINT20031280,
SMINT20045830, SMINT20045890,
SMINT20047290, SMINT20056240,
SMINT20067080, SMINT20070620,
SMINT20077920, SMINT20084910,
SMINT20085310, SMINT20085450,
SMINT20089210, SMINT20092120,
SMINT20093630, SMINT20094150,
SPLEN20005160, SPLEN20005370,
SPLEN20012450, SPLEN20015030,
SPLEN20016500, SPLEN20019120,
SPLEN20020530, SPLEN20023430,
SPLEN20024510, SPLEN20029170,
SPLEN20036780, SPLEN20043430,
SPLEN20043460, SPLEN20045550,
SPLEN20051420, SPLEN20062830,
SPLEN20067010, SPLEN20076190,
SPLEN20081640, SPLEN20087370,
SFLEN20087860, SPLEN20108460,
SPLEN20110210, SPLEN20111450,
SPLEN20114190, SPLEN20117580,
SPLEN20126110, SPLEN20137530,
SPLEN20192570, SPLEN20193750,
SPLEN20197090, SPLEN20197740,
SPLEN20199850, SPLEN20200070,
SPLEN20200340, SPLEN20203590,
SPLEN20205120, TESOP10001600,
TESTI10000850, TESTI20005980,
TESTI20012360, TESTI20019590,
TESTI20028020, TESTI20030610,
TESTI20034750, TESTI20035330,
TESTI20040850, TESTI20045740,
TESTI20049990, TESTI20050170,
TESTI20052670, TESTI20053800,
TESTI20059330, TESTI20059370,
TESTI20059790, TESTI20060150,
TESTI20060450, TESTI20062180,
TESTI20062580, TESTI20064990,
TESTI20066170, TESTI20066280,
TESTI20066590, TESTI20067350,
TESTI20068940, TESTI20076920,
TESTI20079060, TESTI20080460,
TESTI20083890, TESTI20085670,
TESTI20089290, TESTI20090180,
TESTI20090970, TESTI20091360,
TESTI20093900, TESTI20094620,
TESTI20097270, TESTI20107340,
TESTI20113150, TESTI20117500,
TESTI20118460, TESTI20122440,
TESTI20124440, TESTI20125440,
TESTI20132680, TESTI20134010,
TESTI20134270, TESTI20142480,
TESTI20151050, TESTI20152490,
TESTI20159380, TESTI20161010,
TESTI20165680, TESTI20167580,
TESTI20170690, TESTI20170890,
TESTI20173110, TESTI20179510,
TESTI20182210, TESTI20184280,
TESTI20184820, TESTI20192570,
TESTI20193520, TESTI20197290,
TESTI20198600, TESTI20199980,
TESTI20200120, TESTI20200840,
TESTI20205150, TESTI20211380,
TESTI20219390, TESTI20221790,
TESTI20223380, TESTI20248850,
TESTI20254090, TESTI20254480,
TESTI20259200, TESTI20260140,
TESTI20265150, TESTI20265340,
TESTI20265890, TESTI20269250,
TESTI20269360, TESTI20272380,
TESTI20277300, TESTI20287760,
THYMU20007750, THYMU20008000,
THYMU20009460, THYMU20009710,
THYMU20010710, THYMU20012560,
THYMU20014430, THYMU20018390,
THYMU20019000, THYMU20020370,
THYMU20021540, THYMU20029830,
THYMU20036500, THYMU20043440,
THYMU20043560, THYMU20044100,
THYMU20044520, THYMU20051340,
THYMU20058550, THYMU20060480,
THYMU20062520, THYMU20064680,
THYMU20069130, THYMU20069460,
THYMU20069650, THYMU20071460,
THYMU20072580, THYMU20073070,
THYMU20073080, THYMU20078020,
THYMU20080490, THYMU20083500,
THYMU20084520, THYMU20086430,
THYMU20089170, THYMU20089900,
THYMU20091040, THYMU20112570,
THYMU20115730, THYMU20117850,
THYMU20128910, THYMU20129020,
THYMU20130470, THYMU20134260,
THYMU20140510, THYMU20148010,
THYMU20149230, THYMU20157620,
THYMU20174490, THYMU20174790,
THYMU20175260, THYMU20177070,
THYMU20181890, THYMU20187210,
TKIDN10001710, TRACH20012490,
TRACH20021000, TRACH20025370,
TRACH20026640, TRACH20041090,
TRACH20044990, TRACH20049500,
TRACH20051590, TRACH20057200,
TRACH20080810, TRACH20093480,
TRACH20101590, TRACH20123870,
TRACH20124970, TRACH20125620,
TRACH20129180, TRACH20140180,

-continued

TRACH20158240, TRACH20160800,
TRACH20174980, TRACH20182780,
TRACH20185120, UTERU10001870,
UTERU20000230, UTERU20011760,
UTERU20013890, UTERU20027360,
UTERU20029930, UTERU20031350,
UTERU20040370, UTERU20040390,
UTERU20040730, UTERU20041970,
UTERU20065470, UTERU20079240,
UTERU20090940, UTERU20091470,
UTERU20102260, UTERU20103040,
UTERU20106510, UTERU20140010,
UTERU20167570, UTERU20173030,
UTERU20176230

EXAMPLE 7

Expression Frequency Analysis in Silico

The CDNA libraries derived from various tissues and cells as indicated in Example 1 were prepared, and CDNA clones were selected from each library at random. The 5'-end sequences were determined and the database was constructed based on the data. The database was constructed based on the nucleotide sequences of 770,546 clones, and thus the population of the database is large enough for the analysis.

Then, clones having a homologous sequence are categorized into a single cluster (clustering) by searching the nucleotide sequences of respective clones in this database with the program of nucleotide sequence homology search; the number of clones belonging to each cluster was determined and normalized for every library; thus, the ratio of a certain gene in each cDNA library was determined. This analysis gave the information of the expression frequency of genes in tissues and cells which were sources of the cDNA libraries.

Then, in order to analyze the expression of a gene containing the nucleotide sequence of the cDNA of the present invention in tissues and cells, the library derived from a tissue or a cell used in the large-scale cDNA analysis was subjected to the comparison of the expression levels between tissues or cells. Namely, the expression frequency was analyzed by comparing the previously normalized values between tissues and/or cells for which the nucleotide sequences of 600 or more cDNA clones had been analyzed. By this analysis, some of the genes were revealed to be involved in the pathology and functions indicated below. Each value in Tables 3 to 39 shown below represents a relative expression frequency; the higher the value, the higher the expression level.

Osteoporosis-Related Genes

Osteoporosis is a pathology in which bones are easily broken owing to overall decrease in components of bone. The onset involves the balance between the functions of osteoblast producing bone and osteoclast absorbing bone, namely bone metabolism. Thus, the genes involved in the increase of osteoclasts differentiating from precursor cells of monocyte/macrophage line (Molecular Medicine 38. 642–648. (2001)) are genes involved in osteoporosis relevant to bone metabolism.

A nucleotide sequence information-based analysis was carried out to identify the genes whose expression frequencies are higher or lower in CD34+ cell (cell expressing a glycoprotein CD34) treated with the osteoclast differentiation factor (Molecular Medicine 38. 642–648. (2001)) than in the untreated CD34+ cell, which is the precursor cell of monocyte/macrophage line. The result of comparative analysis for the frequency between the two cDNA libraries prepared from the RNA of CD34+ cells (CD34C) and from the RNA of CD34+ cells treated with the osteoclast differentiation factor (D30ST, D60ST or D90ST) showed that the genes whose expression levels were different between the two were the following clones (Table 3).

ASTRO20010290, BRAMY20036530,
BRAMY20043630, BRAMY20089770,
BRAMY20190550, CD34C20001750,
FCBBF20066340, FEBRA20040290,
HLUNG20015180, HLUNG20041590,
HLUNG20052300, KIDNE20084040,
MESAN20021860, MESAN20027240,
NTONG20055200, PROST20016760,
PUAEN10001640, SMINT20006020,
SMINT20028840, SMINT20035050,
SPLEN20181570, TESTI20064530,
TESTI20210030, THYMU20029830,
THYMU20139160, TRACH20051590

These genes are involved in osteoporosis.

Genes Involved in Neural Cell Differentiation

Genes involved in neural cell differentiation are useful for treating neurological diseases. Genes with varying expression levels in response to induction of cellular differentiation in neural cells are thought to be involved in neurological diseases.

A survey was performed for genes whose expression levels are varied in response to induction of differentiation (stimulation by retinoic acid (RA) or growth inhibitor treatment after RA stimulation) in cultured cells of a neural strain, NT2. The result of comparative analysis of cDNA libraries derived from undifferentiated NT2 cells (NT2RM) and the cells subjected to the differentiation treatment (NT2RP, NT2RI or NT2NE) showed that the genes whose expression levels were different between the two were the following clones (Table 4).

ADRGL20023920, ASTRO20009140, BNGH420077980,
BNGH420086030, BRACE20062580, BRACE20079370,
BRACE20215410, BRAMY20003540, BRAMY20043630,
BRAMY20076130, BRAMY20095080, BRAMY20227860,
BRAWH20082550, BRHIP10001040, BRSSN20005610,
CTONG20027660, CTONG20044230, CTONG20066110,
CTONG20079590, CTONG20084660, CTONG20133720,
CTONG20165750, CTONG20188080, FCBBF20023490,
FCBBF20033360, FCBBF20059660, FCBBF20070950, FCBBF30004340,
FCBBF30095410, FCBBF30125460, FCBBF30179180, FCBBF30236670,
FCBBF30257370, FCBBF50000610, FCBBF50001650,
FEBRA20038330, FEBRA20039260, FEBRA20063720,
FEBRA20090220, FEBRA20150420, HEART10001490,
HLUNG20032460, HLUNG20041590, KIDNE20089870,
MESAN20016270, MESAN20021860, MESAN20060430,
MESAN20067430, NT2NE20018740, NT2NE20018890,
NT2NE20021860, NT2NE20026200, NT2NE20026510,
NT2NE20028700, NT2NE20033150, NT2NE20037050,
NT2NE20038870, NT2NE20039210, NT2NE20042550,
NT2NE20045190, NT2NE20047870, NT2NE20053230,
NT2NE20053950, NT2NE20059210, NT2NE20059680,
NT2NE20060750, NT2NE20061030, NT2NE20062880,
NT2NE20064780, NT2NE20066590, NT2NE20069580,
NT2NE20070520, NT2NE20073650, NT2NE20077250,
NT2NE20077270, NT2NE20077860, NT2NE20079670,
NT2NE20080770, NT2NE20082130, NT2NE20082600,
NT2NE20086070, NT2NE20087270, NT2NE20087850,

-continued

NT2NE20088030, NT2NE20092950, NT2NE20095230,
NT2NE20104000, NT2NE20107810, NT2NE20108420,
NT2NE20111190, NT2NE20112210, NT2NE20114850,
NT2NE20117580, NT2NE20119980, NT2NE20123610,
NT2NE20124570, NT2NE20126030, NT2NE20127900,
NT2NE20140130, NT2NE20140280, NT2NE20141040,
NT2NE20145250, NT2NE20146510, NT2NE20148690,
NT2NE20149500, NT2NE20150610, NT2NE20152620,
NT2NE20153620, NT2NE20155650, NT2NE20157120,
NT2NE20165190, NT2NE20167660, NT2NE20173970,
NT2NE20177210, NT2NE20181760, NT2NE20181800,
NT2NE20184720, NT2RI20016240, NT2RI20021200, NT2RI20033920,
NT2RI20093010, NT2RP70001120, NT2RP70001730, NT2RP70003110,
NT2RP70012830, NT2RP70022820, NT2RP70027790, NT2RP70029780,
NT2RP70030840, NT2RP70031070, NT2RP70031340, NT2RP70031480,
NT2RP70035110, NT2RP70046410, NT2RP70049610, NT2RP70056290,
NT2RP70056690, NT2RP70057500, NT2RP70064570, NT2RP70074800,
NT2RP70075300, NT2RP70075800, NT2RP70080150, NT2RP70084540,
NT2RP70087140, NT2RP70090870, OCBBF20001780,
OCBBF20009820, OCBBF20142290, OCBBF20155030,
OCBBF20175360, OCBBF20177540, OCBBF20177910,
PLACE60054820, PLACE60061370, PLACE60073090,
PLACE60162100, PROST20011800, PROST20045700,
PROST20078710, PROST20094000, PUAEN10000650,
PUAEN10001640, SKNMC20006350, SMINT20016150,
SMINT20030740, SMINT20035510, SMINT20039050,
SMINT20047290, SPLEN20063250, SPLEN20117580, SPLEN20125230,
TESTI20030610, TESTI20043910, TESTI20066280, TESTI20067480,
TESTI20105130, TESTI20106170, TESTI20143180, TESTI20221790,
TESTI20254090, TESTI20274960, THYMU10004280,
THYMU20007020, THYMU20104480, THYMU20139160,
TRACH20026640, UTERU10001060, UTERU20026620,
UTERU20079240, UTERU20083020, UTERU20102260,
UTERU20132620

These genes are neurological disease-related genes.

Cancer-Related Genes

It has been assumed that, distinct from normal tissues, cancer tissues express a distinct set of genes, and thus the expression can contribute to the carcinogenesis in tissues and cells. Thus, the genes whose expression patterns in cancer tissues are different from those in normal tissues are cancer-related genes. Search was carried out for the genes whose expression levels in cancer tissues were different from those in normal tissues.

The result of comparative analysis of cDNA libraries derived from breast tumor (TBAES) and normal breast (BEAST) showed that the genes whose expression levels were different between the two were the following clones (Table 5). CTONG20070780, CTONG20084660, HLUNG20045340, TESTI20047370

The result of comparative analysis of cDNA libraries derived cervical tumor (TCERX) and normal cervical duct (CERVX) showed that the genes whose expression levels were different between the two were the following clones (Table 6). SMINT20030740

The result of comparative analysis of cDNA libraries derived from colon tumor (TCOLN) and normal colon (COLON) showed that the genes whose expression levels were different between the two were the following clones (Table 7). UTERU2004037

The result of comparative analysis of cDNA libraries derived from esophageal tumor (TESOP) and normal esophagus (NESOP) showed that the genes whose expression levels were different between the two were the following clones (Table 8).

HLUNG20015180, NESOP20004520,
NESO220005040, TESOP10000350,
TESOP10001600, THYMU20071120

The result of comparative analysis of cDNA libraries derived from kidney tumor (TKIDN) and normal kidney (KIDNE) showed that the genes whose expression levels were different between the two were the following clones (Table 9).

ASTRO20009140, ASTRO20027330,
ASTRO20055930, BGGI20010750,
BNGH420074600, BRACE20050870,
BRACE20054480, BRACE20062580,
BRACE20219360, BRAMY20003540,
BRAMY20003880, BRAMY20043630,
BRAMY20055760, BRAMY20125360,
BRAMY20190550, BRAMY20204270,
BRAMY20227860, BRAWH20014590,
BRAWH20093070, BRHIP10001040,
CTONG20033750, CTONG20039370,
CTONG20045500, CTONG20079590,
FCBBF20023490, FCBBF30004340,
FCBBF30106950, FCBBF30115230,
FCBBF30169280, FCBBF30225930,
FCBBF30282020, FEBRA20038330,
FEBRA20039260, FEBBA20040290,
FEBRA20082660, FEBRA20121200,
FEBRA20170240, HEART10001490,
HLUNG20041590, HLUNG20068120,
HLUNG20072450, HLUNG20083480,
HLUNG20083960, KIDNE20011600,
KIDNE20016360, KIDNE20024380,
KIDNE20027980, KIDNE20080690,
KIDNE20081170, KIDNE20083150,
KIDNE20083620, KIDNE20084030,
KIDNE20084040, KIDNE20084730,
KIDNE20084800, KIDNE20086490,
KIDNE20086660, KIDNE20086970,
KIDNE20087880, KIDNE20088240,
KIDNE20089870, KIDNE20091090,
KIDNE20094260, KIDNE20094670,
KIDNE20095530, KIDNE20133460,
KIDNE20133880, KIDNE20134130,
KIDNE20134890, KIDNE20137310,
KIDNE20138450, KIDNE20140870,
KIDNE20141120, KIDNE20141700,
KIDNE20142680, KIDNE20142680,
KIDNE20142900, KIDNE20143200,
KIDNE20147170, KIDNE20148080,
KIDNE20149780, KIDNE20150730,
KIDNE20152440, KIDNE20154330,
KIDNE20154830, KIDNE20155980,
KIDNE20157100, KIDNE20160360,
KIDNE20160960, KIDNE20163710,
KIDNE20165390, KIDNE20169180,
KIDNE20170400, KIDNE20173150,
KIDNE20173430, KIDNE20176030,
KIDNE20181670, KIDNE20182540,
KIDNE20186170, KIDNE20188630,
KIDNE20189890, KIDNE20189960,
KIDNE20191870, MESAN20038520,
MESAN20041380, OCBBF20016390,
OCBBF20142290, OCBBF20174890,
PLACE60061370, PLACE60073090,
PLACE60181870, PROST20016760,
PUAEN10000650, SMINT20039050,
SMINT20089210, SPLEN20017610,
SPLEN20024930, SPLEN20057830,
SPLEN20063250, SPLEN20126110,
SPLEN20135030, SPLEN20136700,
TESTI20070740, TESTI20262150,
THYMU20009500, THYMU20019260,

-continued

THYMU20157620, TKIDN10000620,
TKIDN10001710, TKIDN10001920,
TRACH20011010, UMVEN10001380

The result of comparative analysis of cDNA libraries derived from liver tumor (TLIVE) and normal liver (LIVER) showed that the genes whose expression levels were different between the two were the following clones (Table 10).

CTONG20069320, FCBBF30236670,
FEBRA20038220, FEBRA20039260,
KIDNE20087880, LIVER20006260,
LIVER20007690, LIVER20007750,
LIVER20010510, LIVER20010760,
LIVER20010990, LIVER20011640,
LIVER20013890, LIVER20026440,
LIVER20030650, LIVER20032340,
LIVER20038000, LIVER20040740,
LIVER20055270, MESAN20027240,
NT2RI20021200, SKMUS20006790,
TESTI20035330, THYMU10004280,
THYMU20029830

The result of comparative analysis of cDNA libraries derived from lung tumor (TLUNG) and normal lung (HLUNG) showed that the genes whose expression levels were different between the two were the following clones (Table 11).

HLUNG20052300, SMINT20035050,
HLUNG20041590, PROST20016760,
BRAMY20043630, HLUNG20015180,
THYMU20139160, HLUNG20020850,
HLUNG20032460, BRAMY20204270,
BRAMY20001510, BRAMY20227860,
CTONG20029030, CTONG20168460,
CTONG20186290, FEBRA20039260,
FEBRA20078800, FEBPA20163980,
HCHON20000870, HLUNG20008460,
HLUNG20009260, HLUNG20009550,
HLUNG20010130, HLUNG20011260,
HLUNG20011440, HLUNG20011460,
HLUNG20012140, HLUNG20014590,
HLUNG20015070, HLUNG20020500,
HLUNG20021450, HLUNG20023030,
HLUNG20024050, HLUNG20025620,
HLUNG20028110, HLUNG20029420,
HLUNG20029490, HLUNG20030420,
HLUNG20030490, HLUNG20030610,
HLUNG20031620, HLUNG20033060,
HLUNG20033310, HLUNG20033350,
HLUNG20034970, HLUNG20037140,
HLUNG20037160, HLUNG20037780,
HLUNG20038330, HLUNG20041540,
HLUNG20042730, HLUNG20045340,
HLUNG20047070, HLUNG20050760,
HLUNG20051330, HLUNG20054790,
HLUNG20055240, HLUNG20056560,
HLUNG20057380, HLUNG20059240,
HLUNG20060670, HLUNG20063700,
HLUNG20065700, HLUNG20065990,
HLUNG20067810, HLUNG20068120,
HLUNG20069350, HLUNG20070410,
HLUNG20072100, HLUNG20072190,
HLUNG20072450, HLUNG20074330,
HLUNG20079310, HLUNG20081390,

-continued

HLUNG20081530, HLUNG20082350,
HLUNG20083310, HLUNG20083480,
HLUNG20083840, HLUNG20083960,
HLUNG20084790, HLUNG20085210,
HLUNG20088750, HLUNG20092530,
HLUNG20093030, HLUNG20094130,
KIDNE20142900, PROST20052850,
SKNMC20006350, SPLEN20012450,
TESTI20057590, TESTI20061200,
TESTI20067480, TESTI20116050,
THYMU10004280, THYMU20010180,
TRACH20011010, UTERU20016580,
UTERU20127030

The result of comparative analysis of cDNA libraries derived from ovary tumor (TOVER) and normal ovary (NOVER) showed the genes whose expression levels were different between the two were the following clones (Table 12).

KIDNE20089870, NT2RP70075300, TESTI20132310

The result of comparative analysis of cDNA libraries derived from stomach tumor (TSTOM) and normal stomach (STOMA) showed that the genes whose expression levels were different between the two were the following clones (Table 13).

BNGH420087430, BRAMY20227860,
BRAWH20027250, CTONG20174440,
FEBRA20090220, PUAEN10000650,
SMINT20023110, SMINT20030740,
SMINT20045890, SPLEN20048800,
SPLEN20139360, TESTI20063410,
TESTI20150920, TRACH20026640,
UTERU20041970

The result of comparative analysis of cDNA libraries derived from uterine tumor (TUTER) and normal uterus (UTERU) showed that the genes whose expression levels were different between the two were the following clones (Table 14).

ADRGL20020290, BRACE20038920,
BRAMY20091230, BRAMY20093490,
BRAMY20227860, BRHIP20005060,
CTONG20069320, CTONG20083430,
FCBBF30005360, FCBBF30257370,
FEBRA20038330, FEBRA20039260,
FEBRA20040260, FEBRA20078180,
FEBRA20087550, HLUNG20015070,
HLUNG20015180, MESAN20007110,
MESAN20067430, MESAN20095800,
NT2RP70057500, SKMUS20008730,
SKNMC20006350, SMINT20035050,
SMINT20045890, SPLEN20073880,
SPLEN20076470, SPLEN20118050,
TESTI20030610, TESTI20035330,
TESTI20057590, TESTI20059080,
TESTI20105130, THYMU10004280,
THYMU20139160, UTERU10001060,

-continued

UTERU10001870, UTERU20000230,
UTERU20000950, UTERU20011760,
UTERU20013890, UTERU20016580,
UTERU20026620, UTERU20027360,
UTERU20029930, UTERU20031350,
UTERU20035770, UTERU20040150,
UTERU20040370, UTERU20040390,
UTERU20040730, UTERU20041630,
UTERU20041970, UTERU20045200,
UTERU20051790, UTERU20064120,
UTERU20065470, UTERU20079240,
UTERU20083020, UTERU20086530,
UTERU20087070, UTERU20087850,
UTERU20089300, UTERU20089390,
UTERU20089620, UTERU20090940,
UTERU20091470, UTERU20094830,
UTERU20095100, UTERU20099040,
UTERU20099510, UTERU20101150,
UTERU20102260, UTERU20103040,
UTERU20103200, UTERU20104310,
UTERU20106510, UTERU20121140,
UTERU20122520, UTERU20125810,
UTERU20127030, UTERU20127150,
UTERU20128560, UTERU20132620,
UTERU20134830, UTERU20139760,
UTERU20140010, UTERU20167570,
UTERU20168960, UTERU20169020,
UTERU20173030, UTERU20176230,
UTERU20177150, UTERU20181270,
UTERU20185220, UTERU20188670,
UTERU20188840

The result of comparative analysis of cDNA libraries derived from tongue cancer (CTONG) and normal tongue (NTONG) showed that the genes whose expression levels were different between the two were the following clones (Table 15).

ADRGL20023920, BRACE20038920,
BRACE20050870, BRACE20061620,
BRAMY20036530, BRAMY20076130,
BRAMY20204270, BRAMY20267780,
BRCAN10001680, CTONG10000090,
CTONG20000340, CTONG20002790,
CTONG20004110, CTONG20004520,
CTONG20007660, CTONG20008190,
CTONG20008460, CTONG20015240,
CTONG20017490, CTONG20020660,
CTONG20020950, CTONG20027660,
CTONG20029030, CTONG20030280,
CTONG20031150, CTONG20031890,
CTONG20032930, CTONG20033500,
CTONG20033610, CTONG20033750,
CTONG20035240, CTONG20036800,
CTONG20036990, CTONG20039370,
CTONG20041150, CTONG20041260,
CTONG20042640, CTONG20044230,
CTONG20044870, CTONG20045500,
CTONG20046690, CTONG20049480,
CTONG20050490, CTONG20051100,
CTONG20051450, CTONG20052780,
CTONG20053990, CTONG20055670,
CTONG20055850, CTONG20056150,
CTONG20057750, CTONG20057950,
CTONG20059130, CTONG20060040,
CTONG20061290, CTONG20062730,
CTONG20063770, CTONG20063930,
CTONG20065240, CTONG20065680,
CTONG20066110, CTONG20068360,
CTONG20069320, CTONG20069420,
CTONG20070090, CTONG20070720,
CTONG20070780, CTONG20070910,
CTONG20071040, CTONG20071680,
CTONG20072930, CTONG20073990,
CTONG20074000, CTONG20074170,
CTONG20074740, CTONG20076230,
CTONG20076810, CTONG20077760,
CTONG20078340, CTONG20079590,
CTONG20080140, CTONG20081840,
CTONG20083430, CTONG20083980,
CTONG20084020, CTONG20084660,
CTONG20085210, CTONG20133720,
CTONG20165590, CTONG20165750,
CTONG20166580, CTONG20167750,
CTONG20168240, CTONG20168460,
CTONG20169040, CTONG20169530,
CTONG20170940, CTONG20174290,
CTONG20174580, CTONG20176040,
CTONG20179390, CTONG20179890,
CTONG20179980, CTONG20180620,
CTONG20180690, CTONG20181350,
CTONG20183430, CTONG20183830,
CTONG20184130, CTONG20184830,
CTONG20186140, CTONG20186290,
CTONG20186370, CTONG20186520,
CTONG20186550, CTONG20188080,
CTONG20189000, CTONG20190290,
CTONG20190630, FCBBF20070950,
FCBBF30001100, FCBBF30175350,
FCBBF40005000, FEBRA20027070,
FEBRA20038330, FEBRA20039260,
FEBRA20040290, FEBRA20046200,
FEBRA20063720, FEBRA20078800,
FEBRA20090220, HCHON20000870,
HLUNG20068120, MESAN20008150,
MESAN20027900, NT2NE20153620,
NT2RP70001730, NT2RP70012830,
NT2RP70027790, NT2RP70057500,
NT2RP70064570, NT2RP70090870,
NTONG20002230, NTONG20005310,
NTONG20017620, NTONG20029850,
NTONG20031580, NTONG20032100,
NTONG20034540, NTONG20035150,
NTONG20043080, NTONG20048440,
NTONG20049180, NTONG20053630,
NTONG20053730, NTONG20053910,
NTONG20055200, NTONG20058010,
NTONG20058220, OCBBF20110730,
OCBBF20177540, OCBBF20177910,
PROST20016760, PROST20042700,
PROST20050390, PROST20063430,
PROST20130320, PUAEN10000650,
PUAEN10001640, PUAEN20003120,
SKMUS20006790, SKNMC20006350,
SKNSH20007160, SMINT20030740,
SMINT20035510, SMINT20089210,
SPLEN20024930, SPLEN20040780,
SPLEN20063250, SPLEN20181570,
SPLEN20187490, TESTI20047370,
TESTI20057880, TESTI20064530,
TESTI20079980, TESTI20105130,
TESTI20118460, TESTI20121040,
TESTI20197290, THYMU10004280,
THYMU20030460, THYMU20055460,
THYMU20089900, THYMU20121040,
THYMU20139160, THYMU20145990,
TRACH20011010, TRACH20090060,
UTERU20000230, UTERU20000950,
UTERU20016580, UTERU20045200,
UTERU20083020

These genes are involved in cancers.

Further, there is a method to search for genes involved in development and differentiation: the expression frequency analysis in which the expression levels of genes are compared between developing or differentiating tissues and/or cells and adult tissues and/or cells. The genes involved in tissue development and/or differentiation are genes participating in tissue construction and expression of function, and thus are useful genes, which are available for regenerative medicine aiming at convenient regeneration of injured tissues.

Search was carried out for the genes whose expression frequencies were different between developing and/or differentiating tissues and/or cells, and adult tissues and/or cells, by using the information of gene expression frequency based on the database of the nucleotide sequences of 770,546 clones shown above.

The result of comparative analysis of cDNA libraries derived from fetal brain (FCBBF, FEBRA or OCBBF) and adult brain (BRACE, BRALZ, BRAMY, BRAWH, BRCAN, BRCOC, BRHIP, BRSSN, BRSTN or BRTHA) showed that the genes whose expression levels were different between the -two were the following clones (Tables 16 to 36).

ADRGL20020290, ADRGL20021910,
ADRGL20023920, ADRGL20046760,
ADRGL20062330, ADRGL20079060,
ASTRO20009140, ASTRO20020240,
ASTRO20027330, ASTRO20047510,
ASTRO20055530, ASTRO20055570,
ASTRO20055930, ASTRO20090680,
BGGI120010750, BNGH420021680,
BNGH420023870, BNGH420059680,
BNGH420074600, BNGH420086030,
BRACE10000510, BRACE20003310,
BRACE20007330, BRACE20009050,
BRACE20014450, BRACE20017790,
BRACE20018810, BRACE20025820,
BRACE20038920, BRACE20050870,
BRACE20051600, BRACE20051930,
BRACE20052430, BRACE20052530,
BRACE20054080, BRACE20054480,
BRACE20054600, BRACE20055560,
BRACE20057870, BRACE20059110,
BRACE20059810, BRACE20061620,
BRACE20062580, BRACE20063540,
BRACE20065470, BRACE20066360,
BRACE20068710, BRACE20069000,
BRACE20069110, BRACE20069440,
BRACE20079200, BRACE20079370,
BRACE20097540, BRACE20098860,
BRACE20099070, BRACE20194670,
BRACE20196180, BBACE20196960,
BRACE20200770, BRACE20200970,
BRACE20204670, BRACE20205840,
BRACE20207420, BRACE20212450,
BRACE20215410, BRACE20216700,
BRACE20216950, BRACE20219360,
BRAMY10000980, BRAMY10001730,
BRAMY20000210, BRAMY20000250,
BRAMY20001510, BRAMY20003540,
BRAMY20003880, BRAMY20005080,
BRAMY20013670, BRAMY20016780,
BRAMY20020440, BRAMY20021580,
BRAMY20023390, BRAMY20023640,
BRAMY20024790, BRAMY20027390,
BRAMY20027990, BRAMY20028530,
BRAMY20028620, BRAMY20035380,
BRAMY20035830, BRAMY20036530,
BRAMY20036810, BRAMY20038980,
BRAMY20039290, BRAMY20040580,
BRAMY20043520, BRAMY20043630,
BRAMY20044920, BRAMY20045210,
BRAMY20045420, BRAMY20047560,
BRAMY20050640, BRAMY20050940,
BRAMY20051820, BRAMY20052440,
BRAMY20053910, BRAMY20055760,
BRAMY20056620, BRAMY20056840,
BRAMY20063750, BRAMY20072440,
BRAMY20072870, BRAMY20073080,
BRAMY20074110, BRAMY20074860,
BRAMY20076100, BRAMY20076130,
BRAMY20076530, BRAMY20083330,

-continued

BRAMY20083820, BRAMY20089770,
BRAMY20091230, BRAMY20093490,
BRAMY20094890, BRAMY20095080,
BRAMY20095570, BRAMY20096930,
BRAMY20100680, BRAMY20102900,
BRAMY20107980, BRAMY20111780,
BRAMY20117670, BRAMY20118410,
BRAMY20118490, BRAMY20120170,
BRAMY20123400, BRAMY20124970,
BRAMY20125170, BRAMY20125360,
BRAMY20125550, BRAMY20126910,
BRAMY20127310, BRAMY20127760,
BRAMY20134050, BRAMY20135720,
BRAMY20137360, BRAMY20139440,
BRAMY20139750, BRAMY20143870,
BRAMY20152510, BRAMY20155500,
BRAMY20158550, BRAMY20159250,
BRAMY20160020, BRAMY20173480,
BRAMY20190550, BRAMY20194680,
BRAMY20204270, BRAMY20206340,
BRAMY20219620, BRAMY20221600,
BRAMY20223010, BRAMY20225250,
BRAMY20225320, BRAMY20227230,
BRAMY20227860, BRAMY20227960,
BRAMY20231150, BRAMY20234820,
BRAMY20237190, BRAMY20238630,
BRAMY20243120, BRAMY20244490,
BRAMY20245140, BRAMY20245350,
BRAMY20245760, BRAMY20251210,
BRAMY20251750, BRAMY20263000,
BRAMY20267780, BRAMY20269040,
BRAMY20271140, BRAMY20274510,
BRAMY20285650, BRAMY20287400,
BRAWH20014590, BRAWH20020470,
BRAWH20020600, BRAWH20021920,
BRAWH20025490, BRAWH20026010,
BRAWH20027250, BRAWH20030000,
BRAWH20039640, BRAWH20040680,
BRAWH20047790, BRAWH20050740,
BRAWH20055240, BRAWH20055330,
BRAWH20055780, BRAWH20058120,
BRAWH20063010, BRAWH20078080,
BRAWH20078620, BRAWH20080580,
BRAWH20082550, BRAWH20082920,
BRAWH20093040, BRAWH20093070,
BRAWH20094900, BRAWH20095900,
BRAWH20173790, BRAWH20174330,
BRAWH20175230, BRAWH20175340,
BRAWH20176850, BRAWH20182670,
BRAWH20183170, BRAWH20185260,
BRAWH20185270, BRAWH20186010,
BRAWH20188750, BRAWH20190530,
BRAWH20190550, BRAWH20191980,
BRCAN10000760, BRCAN10001050,
BRCAN10001680, BRCAN20001480,
BRCAN20004180, BRCAN20005230,
BRCAN20005410, BRCOC10000400,
BRCOC20000470, BRCOC20003600,
BRHIP10000720, BRHIP10001040,
BRHIP20000210, BRHIP20003590,
BRHIP20005060, BRSSN20001970,
BRSSN20005610, BRSSN20005660,
BRSSN20066440, BRSSN20074640,
BRSSN20091190, BRSSN20092440,
BRSSN20093890, CTONG20032930,
CTONG20035240, CTONG20044870,
CTONG20063930, CTONG20069320,
CTONG20070720, CTONG20071040,
CTONG20071680, CTONG20074170,
CTONG20078340, CTONG20079590,
CTONG20080140, CTONG20085210,
CTONG20133720, CTONG20165750,
CTONG20168240, CTONG20170940,
CTONG20183430, CTONG20186370,
CTONG20188080, FCBBF10000230,
FCBBF10002200, FCBBF10004760,
FCBBF20018680, FCBBF20020440,
FCBBF20021110, FCBBF20023490,
FCBBF20028980, FCBBF20029280,

-continued

FCBBF20032930, FCBBF20033360,
FCBBF20035430, FCBBF20035490,
FCBBF20036360, FCBBF20038230,
FCBBF20038950, FCBBF20041380,
FCBBF20043730, FCBBF20054390,
FCBBF20056580, FCBBF20059660,
FCBBF20061310, FCBBF20066340,
FCBBF20070800, FCBBF20070950,
FCBBF30000010, FCBBF30001020,
FCBBF30001100, FCBBF30001150,
FCBBF30002270, FCBBF30002280,
FCBBF30002330, FCBBF30003610,
FCBBF30004340, FCBBF30004730,
FCBBF30005180, FCBBF30005360,
FCBBF30005500, FCBBF30019140,
FCBBF30019180, FCBBF30019240,
FCBBF30021900, FCBBF30022680,
FCBBF30026580, FCBBF30029250,
FCBBF30035570, FCBBF30042610,
FCBBF30048420, FCBBF30053300,
FCBBF30056980, FCBBF30062490,
FCBBF30063990, FCBBF30068210,
FCBBF30071500, FCBBF30072440,
FCBBF30072480, FCBBF30074530,
FCBBF30074620, FCBBF30075970,
FCBBF30076310, FCBBF30078600,
FCBBF30079770, FCBBF30080730,
FCBBF30081000, FCBBF30085560,
FCBBF30088700, FCBBF30089380,
FCBBF30091010, FCBBF30091520,
FCBBF30093170, FCBBF30095410,
FCBBF30099490, FCBBF30100080,
FCBBF30100120, FCBBF30100410,
FCBBF30101240, FCBBF10101300,
FCBBF30105080, FCBBF30105440,
FCBBF30105860, FCBBF30106950,
FCBBF30107290, FCBBF30107330,
FCBBF30114180, FCBBF30114850,
FCBBF30115230, FCBBF30115920,
FCBBF30118670, FCBBF30118890,
FCBBF30125460, FCBBF30125880,
FCBBF30128420, FCBBF30129010,
FCBBF30130410, FCBBF30130580,
FCBBF30132050, FCBBF30132660,
FCBBF30135890, FCBBF30136230,
FCBBF30138000, FCBBF30142290,
FCBBF30143550, FCBBF30145670,
FCBBF30151190, FCBBF30153170,
FCBBF30157270, FCBBF30161780,
FCBBF30164510, FCBBF30166220,
FCBBF30169280, FCBBF30169870,
FCBBF30170710, FCBBF30171230,
FCBBF30172330, FCBBF30173960,
FCBBF30175350, FCBBF30177290,
FCBBF30179180, FCBBF30179740,
FCBBF30181730, FCBBF30194370,
FCBBF30194550, FCBBF30195690,
FCBBF30195700, FCBBF30197840,
FCBBF30198670, FCBBF30201630,
FCBBF30212210, FCBBF30215240,
FCBBF30220050, FCBBF30222910,
FCBBF30223110, FCBBF30223210,
FCBBF30225930, FCBBF30228940,
FCBBF30230610, FCBBF30236670,
FCBBF30250980, FCBBF30255680,
FCBBF30257370, FCBBF30259050,
FCBBF30260210, FCBBF30260480,
FCBBF30263080, FCBBF30266510,
FCBBF30271990, FCBBF30275590,
FCBBF30282020, FCBBF30285930,
FCBBF30287940, FCBBF40000610,
FCBBF40001920, FCBBF40005000,
FCBBF50000410, FCBBF50000610,
FCBBF50001650, FCBBF50003530,
FCBBF50004950, FEBRA20005040,
FEBRA20007820, FEBRA20018670,
FEBRA20026820, FEBRA20027070,
FEBRA20029620, FEBRA20031000,
FEBRA20031150, FEBRA20031280,
FEBRA20031810, FEBPA20035200,
FEBRA20035240, FEBRA20038220,
FEBRA20038330, FEBRA20038970,
FEBRA20039070, FEBPA20039260,
FEBRA20040230, FEBRA20040260,
FEBRA20040290, FEBRA20040560,
FEBRA20045380, FEBRA20046200,
FEBRA20046280, FEBRA20046510,
FEBRA20057010, FEBRA20063720,
FEBRA20076200, FEBBA20078180,
FEBRA20078800, FEBRA20080860,
FEBRA20082660, FEBRA20083410,
FEBRA20084750, FEBRA20086600,
FEBRA20087550, FEBRA20088610,
FEBRA20088810, FEBRA20090160,
FEBRA20090220, FEBRA20091620,
FEBRA20092760, FEBRA20093270,
FEBRA20093280, FEBRA20095410,
FEBRA20098040, FEBRA20099860,
FEBRA20101410, FEBRA20108020,
FEBRA20108580, FEBRA20115930,
FEBRA20116650, FEBRA20121200,
FEBRA20121950, FEBRA20141980,
FEBRA20150420, FEBRA20151750,
FEBRA20163980, FEBRA20170240,
FEBRA20172230, FEBRA20173330,
FEBRA20175020, FEBRA20175330,
FEBRA20177800, FEBRA20180510,
FEBRA20182030, FEBRA20187460,
FEBRA20191720, HCHON20002650,
HCHON20002710, HEARTI0001490,
HLUNG20008460, HLUNG20011460,
HLUNG20014590, HLUNG20015070,
HLUNG20015180, HLUNG20020850,
HLUNG20028110, HLUNG20031620,
HLUNG20032460, HLUNG20033060,
HLUNG20041590, HLUNG20045340,
HLUNG20056560, HLUNG20068120,
HLUNG20081390, HLUNG20083480,
HLUNG20085210, HLUNG20094130,
KIDNE20080690, KIDNE20084030,
KIDNE20086660, KIDNE20094670,
KIDNE20134130, KIDNE20138450,
KIDNE20140870, KIDNE20149780,
KIDNE20170400, KIDNE20173430,
MESAN20021860, MESAN20030350,
MESAN20034440, MESAN20038520,
MESAN20045750, MESAN20067430,
MESAN20089260, MESAN20095800,
NT2NE20026200, NT2NE20033150,
NT2NE20042550, NT2NE20045190,
NT2NE20053950, NT2NE20061030,
NT2NE20069580, NT2NE20082130,
NT2NE20082600, NT2NE20088030,
NT2NE20092950, NT2NE20095230,
NT2NE20108420, NT2NE20111190,
NT2NE20112210, NT2NE20141040,
NT2NE20177210, NT2NE20181800,
NT2R120021200, NT2RP70001120,
NT2RP70001730, NT2RP70012830,
NT2RP70035110, NT2RP70057500,
NT2RP70075300, NT2RP70087140,
NT2RP70090870, NTONG20002230,
NTONG20017620, NTONG20049180,
NTONG20055200, OCBBF20000740,
OCBBF20001780, OCBBF20005220,
OCBBF20009820, OCBBF20011860,
OCBBF20012520, OCBBF20016390,
OCBBF20016810, OCBBF20109450,
OCBBF20109780, OCBBF20110210,
OCBBF20110730, OCBBF20111370,
OCBBF20111600, OCBBF20112280,
OCBBF20112320, OCBBF20113110,
OCBBF20115360, OCBBF20116250,
OCBBF20117220, OCBBF20118720,
OCBBF20119810, OCBBF20120010,
OCBBF20120950, OCBBF20121910,
OC3BF20123200, OCBBF20142290,
OCBBF20147070, OCBBF20152330,

OCBBF20155030, OCBBF20156450,
OCBBF20157970, OCBBF20160380,
OCBBF20165900, OCBBF20165910,
OCBBF20166890, OCBBF20166900,
OCBBF20167290, OCBBF20170350,
OCBBF20174580, OCBBF20174890,
OCBBF20175360, OCBBF20176650,
OCBBF20177540, OCBBF20177910,
OCBBF20182060, OCBBF20185630,
OCBBF20188280, OCBBF20191950,
PLACE60054820, PLACE60056910,
PLACE60061370, PLACE60064740,
PLACE60073090, PLACE60120280,
PLACE60132200, PLACE60150510,
PLACE60154450, PLACE60157310,
PLACE60162100, PROST10002150,
PROST20014150, PROST20016760,
PROST20024250, PROST20035170,
PROST20035830, PROST20042700,
PROST20045700, PROST20050390,
PROST20054660, PROST20078710,
PROST20094000, PROST20097310,
PROST20097840, PROST20103820,
PROST20114100, PROST20130320,
PROST20151370, PUAEN10000650,
PUAEN10001640, PUAEN20003120,
SKNMC20006350, SKNSH10001010,
SKNSH20007160, SKNSH20030640,
SKNSH20094350, SMINT20000070,
SMINT20002320, SNINT20030740,
SMINT20039050, SMINT20045890,
SMINT20047290, SMINT20048720,
SMINT20056240, SMINT20077920,
SMINT20088690, SMINT20089210,
SMINT20089600, SMINT20094150,
SPLEN20005160, SPLEN20005370,
SPLEN20012450, SPLEN20024930,
SPLEN20040780, SPLEN20048800,
SPLEN20055600, SPLEN20057830,
SPLEN20063250, SPLEN20071820,
SPLEN20073880, SPLEN20076470,
SPLEN20104690, SPLEN20114190,
SPLEN20125230, SPLEN20135030,
SPLEN20136700, SPLEN20175920,
SPLEN20181570, SPLEN20183020,
SPLEN20187490, SPLEN20193490,
SPLEN20193790, SPLEN20197740,
SPLEN20200070, SPLEN20200340,
TESOP10000350, TESTI20005980,
TESTI20030440, TESTI20030610,
TESTI20031410, TESTI20035330,
TESTI20047370, TESTI20050400,
TESTI20050720, TESTI20053780,
TESTI20057430, TESTI20057590,
TESTI20057840, TESTI20057880,
TESTI20059080, TESTI20061200,
TESTI20062580, TESTI20063410,
TESTI20064530, TESTI20066280,
TESTI20067480, TESTI20071630,
TESTI20079980, TESTI20081890,
TESTI20089290, TESTI20090180,
TESTI20105130, TESTI20106170,
TESTI20121040, TESTI20150920,
TESTI20169500, TESTI20193080,
TESTI20215310, TESTI20221790,
TESTI20245860, TESTI20252690,
TESTI20254090, TESTI20261160,
TESTI20262150, TESTI20274960,
THYMU20007750, THYMU20009460,
THYMU20009710, THYMU20019260,
THYMU20028410, THYMU20030460,
THYMU20031130, THYMU20043440,
THYMU20044100, THYMU20044520,
THYMU20049060, THYMU20055460,
THYMU20055740, THYMU20071120,
THYMU20078020, THYMU20089900,
THYMU20091040, THYMU20104480,
THYMU20120240, THYMU20139160,
THYMU20143230, THYMU20150190,
THYMU20157620, THYMU20176010,
TKIDN10001920, TRACH20012490,
TRACH20021000, TRACH20026640,
TRACH20058000, TRACH20090060,
TRACH20159390, UMVEN10001380,
UTERU10001060, UTERU20000230,
UTERU20000950, UTERU20026620,
UTERU20041970, UTERU20065470,
UTERU20079240, UTERU20083020,
UTERU20089300, UTERU20089390,
UTERU20095100, UTERU20102260,
UTERU20103200, UTERU20127150,
UTERU20128560

The result of comparative analysis of cDNA libraries derived from fetal heart (FEHRT) and adult heart (HEART) showed that the genes whose expression levels were different between the two were the following clones (Table 37).

BRAMY20043630, BRAMY20072870,
BRAMY20227860, BRAWH20093070,
BRCAN10001680, FCBBF30053300,
FEBRA20078800, FEBRA20090220,
HCHON20000870, HEART10001420,
HEART10001490, HEART20009590,
HEART20019310, HEART20022200,
HEART20031680, HEART20047640,
HEART20063100, HEART20082570,
HLUNG20083960, PLACE60088240,
PLACE60120280, PROST20016760,
PROST20035170, PROST20062820,
PROST20127450, SKMUS20006790,
SKMUS20008730, TESTI20270130

The result of comparative analysis of cDNA libraries derived from fetal kidney (FEKID) and adult kidney (KIDNE) showed that the genes whose expression levels were different between the two were the following clones (Table 38).

ASTRO20009140, BGGI120010750,
BRACE20054480, BRACE20062580,
BRACE20219360, BRAMY20001510,
BRAMY20003540, BRAMY20003880,
BRAMY20043630, BRAMY20204270,
CTONG20033750, CTONG20039370,
CTONG20045500, FCBBF20023490,
FEBRA20039260, FEBRA20040290,
HEART10001490, HLUNG20041590,
HLUNG20068120, HLUNG20072450,
HLUNG20083960, KIDNE20011600,
KIDNE20016360, KIDNE20024380,
KIDNE20027980, KIDNE20080690,
KIDNE20081170, KIDNE20083150,
KIDNE20083620, KIDNE20084030,
KIDNE20084040, KIDNE20084730,
KIDNE20084800, KIDNE20086490,
KIDNE20086660, KIDNE20086970,
KIDNE20087880, KIDNE20088240,
KIDNE20089870, KIDNE20091090,
KIDNE20094260, KIDNE20094670,
KIDNE20095530, KIDNE20133460,
KIDNE20133880, KIDNE20134130,
KIDNE20134890, KIDNE20137310,
KIDNE20138450, KIDNE20140870,
KIDNE20141120, KIDNE20241700,
KIDNE20142680, KIDNE20142900,

-continued

KIDNE20143200, KIDNE20147170,
KIDNE20148080, KIDNE20149780,
KIDNE20150730, KIDNE20152440,
KIDNE20154330, KIDNE20154830,
KIDNE20155980, KIDNE20157100,
KIDNE20160360, KIDNE20160960,
KIDNE20163710, KIDNE20165390,
KIDNE20169180, KIDNE20170400,
KIDNE20173150, KIDNE20173430,
KIDNE20176030, KIDNE20181670,
KIDNE20182540, KIDNE20186170,
KIDNE20188630, KIDNE20189890,
KIDNE20189960, KIDNE20191870,
OCBBF20174890, PLACE60073090,
PLACE60181870, PROST20016760,
PUAEN10000650, SKNMC20006350,
SPLEN20017610, SPLEN20063250,
SPLEN20126110, SPLEN20235030,
TESTI20061200, TESTI20262150,
THYMU10004280, THYMU20139160,
TRACH20011010

The result of comparative analysis of CDNA libraries derived from fetal lung (FELNG) and adult lung (HLUNG) showed that the genes whose expression levels were different between the two were the following clones (Table 39).

BRAMY20001510, BRAMY20043630,
BRAMY20204270, BRAMY20227860,
CTONG20029030, CTONG20168460,
CTONG20186290, FEBRA20039260,
FEBRA20078800, FEBRA20163980,
HCHON20000870, HLUNG20008460,
HLUNG20009260, HLUNG20009550,
HLUNG20010130, HLUNG20011260,
HLUNG20011440, HLUNG20011460,
HLUNG20012140, HLUNG20014590,
HLUNG20015070, HLUNG20015180,
HLUNG20020500, HLUNG20020850,
HLUNG20021450, HLUNG20023030,
HLUNG20024050, HLUNG20025620,
HLUNG20028110, HLUNG20029420,
HLUNG20029490, HLUNG20030420,
HLUNG20030490, HLUNG20030610,
HLUNG20031620, HLUNG20032460,
HLUNG20033060, HLUNG20033310,
HLUNG20033350, HLUNG20034970,
HLUNG20037140, HLUNG20037160,
HLUNG20037780, HLUNG20038330,
HLUNG20041540, HLUNG20041590,
HLUNG20042730, HLUNG20045340,
HLUNG20047070, HLUNG20050760,
HLUNG20051330, HLUNG20052300,
HLUNG20054790, HLUNG20055240,
HLUNG20056560, HLUNG20057380,
HLUNG20059240, HLUNG20060670,
HLUNG20063700, HLUNG20065700,
HLUNG20065990, HLUNG20067810,
HLUNG20068120, HLUNG20069350,
HLUNG20070410, HLUNG20072100,
HLUNG20072190, HLUNG20072450,
HLUNG20074330, HLUNG20079310,
HLUNG20081390, HLUNG20081530,
HLUNG20082350, HLUNG20083330,
HLUNG20083480, HLUNG20083840,
HLUNG20083960, HLUNG20084790,
HLUNG20085210, HLUNG20088750,
HLUNG20092530, HLUNG20093030,
HLUNG20094130, KIDNE20142900,
PROST20016760, PROST20052850,
SKNMC20006350, SMINT20035050,
SPLEN20012450, TESTI20057590,
TESTI20061200, TESTI20067480,

-continued

TESTI20116050, THYMU10004280,
THYMU20010180, THYMU20139160,
TRACH20011010, UTERU20016580,
UTERU20127030

These genes are involved in regeneration of tissues and/or cells.

EXAMPLE 8

Expression Frequency Analysis by PCR

Specific PCR primers were prepared based on the full-length nucleotide sequences, and the expression frequency was analyzed by the ATAC-PCR method (Adaptor-tagged competitive PCR method: Nucleic Acids Research 1997, 25(22): 4694–4696; "DNA Micro-array and Advanced PCR Techniques", Cell Technology, supplement, Eds., Muramatsu and Nawa (Shujunsha, 2000): 104–112). Inflammation-related genes can be identified by revealing the genes whose expression levels are altered depending on the presence of an inflammation-inducing factor. Then, by using THP-1 cell line, which is a cell line of monocyte line, and TNF-α, which is an inflammation-inducing factor, suitable for this system, the genes whose expression levels are altered depending on the presence of the factor were searched for by the system.

THP-1 cell line (purchased from DAINIPPON PHARMACEUTICAL) was cultured to be confluent in RPMI1640 medium (sigma) containing 5% fetal calf serum (GIBCO BRL). Then, the medium was changed with the medium containing 10 ng/ml TNF-α (human recombinant TNF-α; Pharmacia Biotech), and the culture was continued at 37° C. under 5% $CO_2$. After three hours, the cells were harvested, and total RNA was extracted from them by using ISOGEN reagent (Nippon Gene). The extraction was carried out according to the method in the document attached to ISOGEN reagent. In addition, total RNA was also extracted from the cells cultured without stimulation of TNF-α.

The genes involved in the onset of gastritis and gastroduodenal ulcer induced by the infection of *Helicobacter pylori* to the epithelia of stomach can be identified by revealing the genes whose expression levels are altered depending on co-culturing the cells with *Helicobacter pylori*. A recent study has suggested that various substances derived from *Helicobacter pylori* trigger the inflammation reaction. In particular, the members belonging to the family of genes called "cag pathogenicity island (cag PAI)" contribute to the activation of the NF-κB pathway (Gastroenterology 2000, 119: 97–108). Further, it has been found that cag PAI is involved in the onset of gastritis and the like by the study using an animal model (Journal of Experimental Medicine 2000, 192:1601–1610). Then, by using co-culture of a gastric cancer cell line with cag PAI-positive *Helicobacter pylori* (TN2), suitable for this system, the genes whose expression levels are altered depending on the presence of *Helicobacter pylori* were searched for by the system. Further, in order to study the involvement of cag PAI in the alterations of gene expression levels depending on the co-culture with *Helicobacter pylori*, the altered expression levels were compared between the cells co-cultured with a strain of *Helicobacter pylori* (TN2ΔcagE strain) having a mutation in cagE, which is one of the cag PAI genes, and the cag PAI-positive strain (TN2).

A gastric cancer cell line MKN45 (provided by the Cell Bank, RIKEN GENE BANK, The Institute of Physical and Chemical Research) was cultured to be confluent in RPMI1640 medium (sigma) containing 10% fetal calf serum (GIBCO BRL). Then, the Imedium was changed with the medium containing 100-fold excess (in terms of the number of cells or the number of colonies) of *Helicobacter pylori* (cag PAI positive strain (TN2) and cagE mutant (TN2ΔcagE): both were provided by Prof. Omata, Faculty of Medicine, The University of Tokyo), as compared with the number of the cancer cells. The culture was continued at 37° C. under 5% $CO_2$. After three hours, the cells were harvested, and total RNA was extracted from them by using ISOGEN reagent (Nippon Gene). The extraction was carried out according to the method in the document attached to ISOGEN reagent. In addition, total RNA was also extracted from the cells cultured without *Helicobacter pylori*.

The analysis by the ATAC-PCR method was carried out basically according to "DNA Micro-array and Advanced PCR Techniques", Cell Technology, supplement (Genome Science Series 1, Eds., Muramatsu and Nawa (Shujunsha, 2000): 104–112). Adapter ligation to the internal standard sample (sample to make the calibration curve for the clone of interest) and test sample was carried out in the two separate reaction systems indicated below. The combination of 6 types of adapters (AD-1, AD-2, AD-3, AD-4, AD-5 and AD-6: see the sequences indicated below) and the samples are as follows.

Reaction System A
AD1; internal standard, 10-fold
AD2; THP-1 cells, unstimulated
AD3; internal standard, 3-fold
AD4; THP-1 cells, TNF-α stimulation for one hour
AD5; THP-1 cells, TNF-α stimulation for three hours
AD6; internal standard, 1-fold Reaction System B
AD1; internal standard, 1-fold
AD2; MKN45 cells, unstimulated
AD3; internal standard, 3-fold
AD4; MKN45 cells, co-cultured with TN2 (*Helicobacter pylori*)
AD5; internal standard, 10-fold
AD6; MKN45 cells, co-cultured with TN2ΔcagE (cagE gene mutant) Adapter sequences:
AD1;

```
AD1;
//5'-GTACATATTGTCGTTAGAACGCG-3'              SEQ ID NO: 3941
//3'-CATGTATAACAGCAATCTTGCGCCTAG-5'          SEQ ID NO: 3942

AD2;
//5'-GTACATATTGTCGTTAGAACGCGACT-3'           SEQ ID NO: 3943
//3'-CATGTATAACAGCAATCTTGCGCTGACTAG-5'       SEQ ID NO: 3944

AD3;
//5'-GTACATATTGTCGTTAGAACGCGCATACT-3'        SEQ ID NO: 3945
//3'-CATGTATAACAGCAATCTTGCGCGTATGACTAG-5'    SEQ ID NO: 3946

AD4;
//5'-GTACATATTGTCGTTAGAACGCGATCCATACT-3'     SEQ ID NO: 3947
//3'-CATGTATAACAGCAATCTTGCGCTAGGTATGACTAG-5' SEQ ID NO: 3948

AD5;
//5'-GTACATATTGTCGTTAGAACGCGTCAATCCATACT-3'  SEQ ID NO: 3949
//3'-CATGTATAACAGCAATCTTGCGCAGTTAGGTATGACTAG-5' SEQ ID NO: 3950

AD6;
//5'-GTACATATTGTCGTTAGAACGCGTACTCAATCCATACT-3' SEQ ID NO: 3951
//3'-CATGTATAACAGCAATCTTGCGCATGAGTTAGGTATGACTAG-5' SEQ ID NO: 3952
```

The internal standard sample used for this assay was a mixture of total RNAs from tissues (or culture cells; all from UNITECH) of brain, kidney, NT2, testis, thymus, and trachea. RNA was prepared according to the standard method.

The sequences of primers specific to the genes and the names of clones of interest in the analysis are as follows. The gene specific primers were designed to produce the PCR products of 70 to 200 bp, which are derived from the adapter-containing cDNA. The sequence of adapter-specific primer (labeled with fluorescence (FAM)) used in the competitive PCR was GTACATATTGTCGTTAGAACGC (22 nucleotides; SEQ ID NO: 3953). PCR was basically carried out with a cycling profile of preheating at 94° C. for 3 minutes, and 35 or 40 cycles of denaturation at 94° C. for 30 seconds/annealing at 50° C. for 60 seconds/extension at 72° C. for 90 seconds.

The nucleotide sequences of clone specific primers used in the experiments

Clone name, primer sequence and SEQ ID NO are indicated below in this order. Each is demarcated by a double slash mark (//).

```
                                             SEQ ID NO: 3954
    ADRGL20036380//CTACTCAAGGACAGCCACAC//

SEQ ID NO: 3955
    ASTRO20045840//GGATGTAGTGGGAAACAATG//

SEQ ID NO: 3956
    ASTRO20055930//TGCTTTTCATTCTCCTTAGT//

SEQ ID NO: 3957
    ASTRO20088950//TACGTGCTCATTTACTTGGT//

SEQ ID NO: 3958
    BNGH420052350//GCCAGTTTCTTTATGATTGA//

SEQ ID NO: 3959
    BRACE20052530//AATGACTTCGTTAGGATGCC//

SEQ ID NO: 3960
    BRACE20054080//GCTGTTGACTTCATTTGGAA//
```

-continued

SEQ ID NO: 3961
BRAMY20003880//TTGGTACTTATTCTGAGGCA//

SEQ ID NO: 3962
BRAMY20027390//GATTTTAGTGAAACATGCCA//

SEQ ID NO: 3963
BRAMY20028530//TTAAAACTGAGGACATTCTG//

SEQ ID NO: 3964
BRAMY20035380//AGAGAAGGCAGTCTAGCTTA//

SEQ ID NO: 3965
BRAMY20036530//AGGGTATGGTAACTTCTGCA//

SEQ ID NO: 3966
BRAMY20050940//AAAGGAGGGACTAGAAAACT//

SEQ ID NO: 3967
BRAMY20072440//ACTATGACGAGGGAACAAGA//

SEQ ID NO: 3968
BRAMY20096930//GAGGAGAACACAAGTATGGT//

SEQ ID NO: 3969
BRAMY20118410//AAGGTCACTTCTAAACACAC//

SEQ ID NO: 3970
BRAMY20237190//GGAGTGATTCAGGAGATGTG//

SEQ ID NO: 3971
BRAWH20055330//GCAACAGAGACTTTATTGGT//

SEQ ID NO: 3972
BRAWH20078620//GAGAGACTTATCACAGCCAT//

SEQ ID NO: 3973
BRAWH20190530//ATGGGATTCTGTGACTTCTC//

SEQ ID NO: 3974
BRCAN20001480//CAGCAACAGTAATGGGAATT//

SEQ ID NO: 3975
BRHIP10000720//AGGTTAGGATTTCTTTAGCA//

SEQ ID NO: 3976
BRHIP10001040//TACTTGGAGACAACAGGGAG//

SEQ ID NO: 3977
BRHIP20000210//GTGTTTGTGGGCATAGACAT//

SEQ ID NO: 3978
BRSSN20001970//AATGTATTCAGTTCCTTTCC//

SEQ ID NO: 3979
BRSSN20091190//GTGTCATCACTAGCACCAAG//

SEQ ID NO: 3980
CD34C20001750//TGGACTTAGGGACCTGACTC//

SEQ ID NO: 3981
CTONG20078340//CTCTTTACCTAGTTTGGTCA//

SEQ ID NO: 3982
CTONG20079590//TACTTATTTTCACAGGGGCC//

SEQ ID NO: 3983
CTONG20083980//CAGCATTTTCCTATATAGCC//

SEQ ID NO: 3984
CTONG20085210//CCAGAAGAGTAGCAAGAATT//

SEQ ID NO: 3985
DFNES20063460//CTATTTTAACCCCTGCCCTC//

SEQ ID NO: 3986
DFNES20072990//GGAGGTATCTATTAGGGTGA//

SEQ ID NO: 3987

-continued

FCBBF20029280//GACTGAGATGAACTGGAAGA//

SEQ ID NO: 3988
FCBBF20032930//TCACAATACAGTCCCCTAGT//

SEQ ID NO: 3989
FCBBF20036360//ATTTGTATCACTTTGGTGCA//

SEQ ID NO: 3990
FCBBF30022680//CTCCAGAAAATGCATGAATC//

SEQ ID NO: 3991
FCBBF30078600//CTTCAACAGTGCTTTTCCTT//

SEQ ID NO: 3992
FCBBF30105080//CTGTGCACCCACTCTTTATT//

SEQ ID NO: 3993
FCBBF30169870//TCCAGTATTTTCCACTTTGA//

SEQ ID NO: 3994
FCBBF30225930//ACTATTTTATGGTCACGGCC//

SEQ ID NO: 3995
FCBBF50000610//AGTTAACGTATCTGGCAAAG//

SEQ ID NO: 3996
FEBRA20007820//GTTTCTCACTGTCCTGTTTT//

SEQ ID NO: 3997
FEBRA20031280//ACTATTTTATGGTCACGGCC//

SEQ ID NO: 3998
FEBRA20031810//TGCAATCATCTCTGTATCCC//

SEQ ID NO: 3999
FEBRA20039260//GTCAGAACCCACTTCACATC//

SEQ ID NO: 4000
FEBRA20046280//TCTCTGTCCTGTTGTCTAAG//

SEQ ID NO: 4001
FEBRA20084750//TTAGCATGTACTGGGAAAGC//

SEQ ID NO: 4002
FEBRA20182030//AAAACACAAAATGACACCCC//

SEQ ID NO: 4003
HLUNG20041540//AAAGTTCCTCTGCATTCACC//

SEQ ID NO: 4004
HLUNG20092530//TTTTCATCCCAGAGTTATTA//

SEQ ID NO: 4005
KIDNE20084030//AGGGAATAACTTGCAGCTTG//

SEQ ID NO: 4006
KIDNE20084800//GTAATGTAGGGAGACTGCCG//

SEQ ID NO: 4007
KIDNE20134130//AATCCCCTCTTTTGTCTCAT//

SEQ ID NO: 4008
KIDNE20182540//ACAGATAGCCTGGATTGAAA//

SEQ ID NO: 4009
KIDNE20186170//TTGTATCTGAGCTGGGGTTT//

SEQ ID NO: 4010
KIDNE20188630//CCCTACATATCTCTACCCAT//

SEQ ID NO: 4011
LIVER20007750//TATTTAGAAACGCAGACCCC//

SEQ ID NO: 4012
MESAN20021220//TAGAAGTCAACAAAAGGCAC//

SEQ ID NO: 4013
MESAN20084150//TCCATAAGGCACAGATTTGA//

-continued

SEQ ID NO: 4014
NT2NE20059210//ATAATGACAATGCCAGTAGT//

SEQ ID NO: 4015
NT2NE20082130//TGAGGTACATCCAAATTAAA//

SEQ ID NO: 4016
NT2NE20092950//ATGATTACTCGGTTTCCAGA//

SEQ ID NO: 4017
NT2RP70031070//CAGTTAGTAGACAGACGGGG//

SEQ ID NO: 4018
OCBBF20012520//TCTGCCTGTAGTTGCCATTA//

SEQ ID NO: 4019
OCBBF20110210//AGGTGATAGGACTTTGTGCC//

SEQ ID NO: 4020
OCBBF20110730//TTAGATGCTCCCTAAGGTCC//

SEQ ID NO: 4021
OCBBF20155030//GCTAAAATCGTGCATCTGTA//

SEQ ID NO: 4022
OCBBF20165900//AGTTTTGTATCTCCTTGTCA//

SEQ ID NO: 4023
OCBBF20170350//TAAGATGGAGTTCAGGGGAG//

SEQ ID NO: 4024
OCBBF20176650//GCACACAGGCAAATTCTAGT//

SEQ ID NO: 4025
PLACE60006300//TTCTGTAATAAGGGCTGTCA//

SEQ ID NO: 4026
PLACE60061370//TGTTCACAAATGGCATAAAA//

SEQ ID NO: 4027
PROST20011160//CTACTAACTCAACCACGCAT//

SEQ ID NO: 4028
PROST20041460//CCATTTACGTCACCTCTCTG//

SEQ ID NO: 4029
PROST20065100//ACTATTTTATGGTCACGGCC//

SEQ ID NO: 4030
PROST20075280//ACGTTGACTCTGATAGCCTG//

SEQ ID NO: 4031
PROST20106060//AATTCTTTTGACATTGCTTG//

SEQ ID NO: 4032
PROST20110120//GATAAATTCAGCAAGAGCAT//

SEQ ID NO: 4033
SKMUS20091900//AACTCTGCACTCCATAACTG//

SEQ ID NO: 4034
SMINT20024140//AAGCCTCTAAAAGTCAACAC//

SEQ ID NO: 4035
SMINT20092160//TTAAACAAGTGAGCCTCAGA//

SEQ ID NO: 4036
SPLEN20040780//TTTCCTGTTTGGTTAGTTTT//

SEQ ID NO: 4037
SPLEN20110860//CTGACGGAAAACTTCTAATT//

SEQ ID NO: 4038
SPLEN20177400//ATATCTGGTTGTTGGGTTTT//

SEQ ID NO: 4039
TESTI20038240//GTCTGTCTTGATGGATTGGA//

SEQ ID NO: 4040
TESTI20043130//AACTATCAGACTGCAAGAGC//

SEQ ID NO: 4041
TESTI20046540//GGTAGCCAATAGCAAACAGG//

SEQ ID NO: 4042
TESTI20047370//ACGTTGCATAATCCTCAGTC//

SEQ ID NO: 4043
TESTI20057200//AGTCCCAGTCTCTAGTTCGG//

SEQ ID NO: 4044
TESTI20057590//ACATTTTGGTATTGACACTT//

SEQ ID NO: 4045
TESTI20113940//GTCAGTCCACCTTACTCTTT//

SEQ ID NO: 4046
TESTI20149880//CAAACGATTACGACACAAAA//

SEQ ID NO: 4047
TESTI20151800//CGTTCCTCAGGTAGCAAGAT//

SEQ ID NO: 4048
TESTI20173050//ACATGGCTGAAGGTGATTTT//

SEQ ID NO: 4049
TESTI20198600//TTTAGAAACATTGGCATCAG//

SEQ ID NO: 4050
TESTI20257910//CTGCCTAGAGTAGAACAAAA//

SEQ ID NO: 4051
TESTI20262940//CTCCCAATCTCAAACACAAG//

SEQ ID NO: 4052
THYMU20046770//CTTCTGCCGAGTTTGTGTAA//

SEQ ID NO: 4053
THYMU20058550//GATGCTGAGAAGGTGTTAGT//

SEQ ID NO: 4054
THYMU20062520//AGTCTCAGGATGGGTAAAGG//

SEQ ID NO: 4055
THYMU20062770//AGAGTTAAGAACCGAGGGAT//

SEQ ID NO: 4056
THYMU20078240//CAAGCCAGGGAGATAGACAT//

SEQ ID NO: 4057
THYMU20150190//TACTACAATGTGGGCTACGG//

SEQ ID NO: 4058
TRACH20125620//CCACATTGTAAACAGTCCTT//

SEQ ID NO: 4059
TRACH20149740//AGATACATTTTCCGTCAAGC//

SEQ ID NO: 4060
TRACH20190460//CCAGAAGAGTAGCAAGAATT//

SEQ ID NO: 4061
UTERU20045200//ATTCAACTAAAACAAAGCTG//

SEQ ID NO: 4062
UTERU20064120//ACCCAGAAAAGAGATGAGAA//

SEQ ID NO: 4063
UTERU20103200//CTGTTCCTGGCAAATAAGAG//

SEQ ID NO: 4064
ADRGL20046760//ATGTGAAGGAATGATGTACT//

SEQ ID NO: 4065
ASTRO20055530//GAATAATGAAGGGGACCAGA//

SEQ ID NO: 4066
BRAMY20076130//CCTTTCATGTCTCAGTATTT//

SEQ ID NO: 4067

-continued

CTONG20170940//ATACGTCAGAGGACACATGC//

SEQ ID NO: 4068
FCBBF20033360//TCCGTAGCAGTAGAAACATC//

SEQ ID NO: 4069
FCBBF30257370//CAGGTATGCTTGGAGTTTCA//

SEQ ID NO: 4070
FCBBF50001650//CGTGATTAGGAAGGGACAGT//

SEQ ID NO: 4071
FEBRA20040290//CCCAAGAACGAAACAAAACT//

SEQ ID NO: 4072
FEBRA20063720//AATAATGCCCACCTATAAAA//

SEQ ID NO: 4073
FEBRA20098040//GAGGGGAATTGTCAGTACAC//

SEQ ID NO: 4074
FEBRA20108580//TCATTTTGTCTAGTGCCCAT//

SEQ ID NO: 4075
MESAN20021860//ACACATTCCCATCAATAGGT//

SEQ ID NO: 4076
MESAN20067430//AGCTAAGGAGGTTTTCACAT//

SEQ ID NO: 4077
NT2NE20045190//GGAATATGTTGGGCTAGTTA//

SEQ ID NO: 4078
PROST20016760//AACTTCATCCATTCCAACTG//

SEQ ID NO: 4079
SKNSH20007160//TTAAACCAACATTGAGGAAA//

SEQ ID NO: 4080
SMINT20006020//CTTGGTTGTCCCCTTTCTAG//

SEQ ID NO: 4081
TESTI20059370//GGCTGACTTTTCTCCTACAG//

SEQ ID NO: 4082
TESTI20103690//CCACTTTATTTCTCCTCCCT//

SEQ ID NO: 4083
TESTI20254480//GTGGACACAACTTGCTTTAC//

SEQ ID NO: 4084
THYMU10004280//GAGAGTCTGCCTAGCTGTGT//

SEQ ID NO: 4085
THYMU20030460//GCCCATGTGAGTAGGTGTAG//

SEQ ID NO: 4086
TRACH20090060//AGGGCCAACTTAAATCTCTG//

SEQ ID NO: 4087
UTERU20041970//GATAAACCCCAAACATGAAA//

SEQ ID NO: 4088
BRAMY20125360//GACAGACTAAAACGTTGAGC//

SEQ ID NO: 4089
OCBBF20142290//CCAAGGAGAGTCAGTGACAG//

SEQ ID NO: 4090
SKMUS20006790//TTCAAAAGCAGAGACTCCCT//

SEQ ID NO: 4091
TESTI20030610//TGAACTCAGTACCAGGCTTG//

SEQ ID NO: 4092
UTERU20026620//GAGATTCCCTAGTGGTGGTT//

The result of expression frequency analysis is shown in Table 40. The clones not shown in the table contain clones whose expression levels could not be measured because the levels were too low or the sizes of the PCR products were different from the expected. It was confirmed that the expression levels of IL-8 gene used as a positive control gene were elevated.

The result obtained by the search for the genes whose expression levels were altered depending on the presence of TNF-α in culturing THP-1 cell, which is a human monocyte cell line, showed that the clones whose expression levels were elevated by twofold or more one or three hours after the stimulation (the clones whose expression levels were 0.1 or lower both before and after the stimulation were excluded), were ASTRO20055530, ASTRO20055930, ASTRO20088950, BRAMY20027390, BRAMY20076130, BRAMY20118410, BRAMY20125360, BRAMY20237190, BRCAN20001480, BRHIP10000720, CD34C20001750, CTONG20078340, CTONG20085210, DFNES20063460, FCBBF20029280, FCBBF20033360, FCBBF30078600, FEBRA20007820, FEBRA20031280, FEBRA20031810, FEBRA20040290, HLUNG20041540, HLUNG20092530, MESAN20021860, MESAN20067430, MESAN20084150, NT2NE20092950, NT2RP70031070, OCBBF20012520, OCBBF20142290, OCBBF20165900, OCBBF20170350, OCBBF20176650, PLACE60006300, PROST20011160, PROST20106060, SPLEN20040780, SPLEN20110860, SPLEN20177400, TESTI20030610, TESTI20043130, TESTI20059370, TESTI20254480, THYMU10004280, THYMU20030460, THYMU20062520, THYMU20078240, THYMU20150190, TRACH20090060, TRACH20125620, UTERU20026620, UTERU20045200, UTERU20064120, UTERU20103200.

On the other hand, in particular cases where the expression levels were relatively high in the unstimulated cells (the relative value was 1 or higher), the clones whose expression levels were decreased by twofold or more by the TNF-α stimulation (the clones whose expression levels were increased 1 or 3 hours after the stimulation were excluded) were BNGH420052350, BRACE20052530, BRAMY20003880, CTONG20170940, FCBBF30022680, FCBBF30225930, FCBBF30257370, FEBRA20046280, KIDNE20084030, KIDNE20188630, NT2NE20082130, OCBBF20110210, PLACE60061370, FROST20041460, PROST20075280, PROST20110120, SMINT20006020, TESTI20046540, TESTI20057200, TESTI20113940, TESTI20257910, TESTI20262940, TRACH20149740.

These clones were thus revealed to be involved in the inflammation reaction induced by TNF-α.

The result obtained by the search for the genes whose expression levels were altered depending on co-culturing gastric cancer cell line MKN45 with cag PAI positive *Helicobacter pylori* (TN2), showed that the clones whose expression levels were elevated by twofold or more (the clones whose expression levels were 0.1 or lower both before and after the stimulation were excluded), were BRAMY20028530, BRAMY20035380, OCBBF20170350, PROST20011160, SKMUS20091900, SPLEN20040780, THYMU20078240, TRACH20190460, UTERU20045200, UTERU20064120, ASTRO20055530, CTONG20170940, FEBRA20040290, MESAN20067430, PROST20016760, THYMU10004280, TRACH20090060, UTERU20041970, OCBBF20142290, TESTI20030610.

Of these clones, the expression levels of BRAMY20035380, SKMUS20091900, SPLEN20040780, UTERU20064120, CTONG20170940, OCBBF20142290, TESTI20030610 were not increased by the co-culture with the cagE mutant (TN2ΔcagE). There may be the possibility that the expression levels of the 7 clones are altered via the NF-κB pathway. Among them, the expression levels of OCBBF20142290, SPLEN20040780, TESTI20030610, UTERU20064120 were also increased when human monocyte cell line THP-1 was stimulated with TNF-α.

On the other hand, in particular cases where the expression levels were relatively high in the unstimulated cells (the relative value was 1 or higher), the clones whose expression levels were decreased by twofold or more in the presence of *Helicobacter pylori* were ASTRO20088950, BRACE20052530, BRAMY20003880, BRAMY20027390, BRAMY20036530, BRAMY20118410, BRHIP20000210, FCBBF20032930, FCBBF30022680, FCBBF30169870, FEBRA20182030, KIDNE20182540, LIVER20007750, MESAN20021220, NT2NE20059210, NT2NE20082130, OCBBF20155030, PROST20065100, PROST20075280, SPLEN20110860, TESTI20057200, TESTI20113940, TESTI20149880, TESTI20151800, TESTI20198600, TESTI20257910, THYMU20046770, THYMU20058550, THYMU20150190, FCBBF20033360, FCBBF30257370, FEBRA20098040, SMINT20006020.

These clones are involved in gastritis or gastroduodenal ulcer.

TABLE 3

| Clone ID | CD34C | D30ST | D60ST | D90ST |
|---|---|---|---|---|
| ASTRO20010290 | 0 | 55.437 | 0 | 0 |
| BRAMY20036530 | 0 | 33.144 | 0 | 0 |
| BRAMY20043630 | 0 | 0 | 0 | 13.575 |
| BRAMY20089770 | 0 | 0 | 0 | 63.803 |
| BRAMY20190550 | 0 | 0 | 0 | 31.089 |
| CD34C20001750 | 100 | 0 | 0 | 0 |
| FCBBF20066340 | 0 | 0 | 0 | 76.503 |
| FEBRA20040290 | 0 | 0 | 0 | 14.912 |
| HLUNG20015180 | 0 | 0 | 0 | 8.491 |
| HLUNG20041590 | 0 | 0 | 0 | 18.349 |
| HLUNG20052300 | 0 | 36.241 | 0 | 0 |
| KIDNE20084040 | 0 | 0 | 0 | 65.916 |
| MESAN20021860 | 0 | 0 | 0 | 56.046 |
| MESAN20027240 | 0 | 0 | 0 | 33.731 |
| NTONG20055200 | 0 | 0 | 0 | 19.731 |
| PROST20016760 | 0 | 0 | 0 | 15.442 |
| PUAEN10001640 | 0 | 34.074 | 0 | 0 |
| SMINT20006020 | 0 | 7.702 | 0 | 9.021 |
| SMINT20028840 | 0 | 68.605 | 0 | 0 |
| SMINT20035050 | 0 | 9.417 | 0 | 11.029 |
| SPLEN20181570 | 81.506 | 0 | 0 | 0 |
| TESTI20064530 | 0 | 0 | 77.29 | 0 |
| TESTI20210030 | 0 | 0 | 0 | 90.471 |

TABLE 3-continued

| Clone ID | CD34C | D30ST | D60ST | D90ST |
|---|---|---|---|---|
| THYMU20029830 | 0 | 42.091 | 0 | 0 |
| THYMU20139160 | 0 | 0 | 0 | 3.486 |
| TRACH20051590 | 0 | 0 | 0 | 75.217 |

TABLE 4

| Clone ID | NT2RM | NT2RP | NT2RI | NT2NE |
|---|---|---|---|---|
| ADRGL20023920 | 0 | 6.69 | 0 | 0 |
| ASTRO20009140 | 0 | 0 | 13.389 | 0 |
| BNGH420077980 | 0 | 0 | 20.754 | 0 |
| BNGH420086030 | 0 | 0 | 0 | 13.322 |
| BRACE20062580 | 0 | 0 | 3.585 | 2.717 |
| BRACE20079370 | 0 | 0 | 9.312 | 14.111 |
| BRACE20215410 | 0 | 0 | 27.196 | 0 |
| BRAMY20003540 | 0 | 0 | 3.208 | 4.861 |
| BRAMY20043630 | 0 | 0 | 2.408 | 0 |
| BRAMY20076130 | 0 | 0 | 6.601 | 0 |
| BRAMY20095080 | 0 | 0 | 25.606 | 0 |
| BRAMY20227860 | 0 | 2.798 | 6.17 | 3.596 |
| BRAWH20082550 | 0 | 0 | 0 | 9.738 |
| BRHIP10001040 | 0 | 0 | 0 | 2.323 |
| BRSSN20005610 | 0 | 22.393 | 0 | 0 |
| CTONG20027660 | 0 | 0 | 50.642 | 0 |
| CTONG20044230 | 0 | 0 | 50.642 | 0 |
| CTONG20066110 | 0 | 0 | 19.131 | 0 |
| CTONG20079590 | 0 | 14.297 | 29.102 | 0 |
| CTONG20084660 | 0 | 0 | 2.553 | 0 |
| CTONG20133720 | 0 | 8.861 | 0 | 9.111 |
| CTONG20165750 | 0 | 9.056 | 0 | 0 |
| CTONG20188080 | 0 | 10.319 | 0 | 0 |
| FCBBF20023490 | 0 | 7.376 | 0 | 7.583 |
| FCBBF20033360 | 0 | 0 | 5.015 | 0 |
| FCBBF20059660 | 0 | 0 | 0 | 66.235 |
| FCBBF20070950 | 0 | 0 | 15.367 | 0 |
| FCBBF30004340 | 0 | 0 | 0 | 8.778 |
| FCBBF30095410 | 0 | 79.235 | 0 | 0 |
| FCBBF30125460 | 0 | 0 | 0 | 9.321 |
| FCBBF30179180 | 0 | 0 | 56.418 | 0 |
| FCBBF30236670 | 0 | 1.325 | 4.494 | 2.724 |
| FCBBF30257370 | 0 | 19.522 | 0 | 0 |
| FCBBF50000610 | 0 | 0 | 56.418 | 0 |
| FCBBF50001650 | 0 | 0 | 0 | 22.181 |
| FEBRA20038330 | 0 | 16.124 | 0 | 0 |
| FEBRA20039260 | 0 | 7.162 | 2.43 | 0 |
| FEBRA20063720 | 0 | 12.258 | 0 | 0 |
| FEBRA20090220 | 0 | 4.602 | 3.122 | 4.732 |
| FEBRA20150420 | 0 | 0 | 33.26 | 0 |
| HEART10001490 | 0 | 0 | 9.27 | 0 |
| HLUNG20032460 | 0 | 0 | 0 | 21.278 |
| HLUNG20041590 | 0 | 0 | 0 | 4.932 |
| KIDNE20089870 | 0 | 0 | 0 | 4.145 |
| MESAN20016270 | 0 | 0 | 39.208 | 0 |
| MESAN20021860 | 0 | 0 | 0 | 7.532 |
| MESAN20060430 | 0 | 0 | 24.385 | 0 |
| MESAN20067430 | 0 | 0 | 0 | 9.568 |
| NT2NE20018740 | 0 | 0 | 0 | 100 |
| NT2NE20018890 | 0 | 0 | 0 | 100 |
| NT2NE20021860 | 0 | 0 | 0 | 100 |
| NT2NE20026200 | 0 | 0 | 0.808 | 2.449 |
| NT2NE20026510 | 0 | 0 | 0 | 100 |
| NT2NE20028700 | 0 | 0 | 0 | 22.223 |
| NT2NE20033150 | 0 | 0 | 0 | 50.133 |
| NT2NE20037050 | 0 | 0 | 0 | 100 |
| NT2NE20038870 | 0 | 0 | 0 | 100 |
| NT2NE20039210 | 0 | 0 | 0 | 100 |
| NT2NE20042550 | 0 | 0 | 0 | 59.083 |
| NT2NE20045190 | 0 | 0 | 5.05 | 15.306 |
| NT2NE20047870 | 0 | 0 | 0 | 100 |
| NT2NE20053230 | 0 | 0 | 0 | 100 |
| NT2NE20053950 | 0 | 20.953 | 0 | 21.544 |
| NT2NE20059210 | 0 | 0 | 0 | 100 |
| NT2NE20059680 | 0 | 0 | 0 | 100 |

TABLE 4-continued

| Clone ID | NT2RM | NT2RP | NT2RI | NT2NE |
|---|---|---|---|---|
| NT2NE20060750 | 0 | 0 | 0 | 100 |
| NT2NE20061030 | 0 | 39.18 | 0 | 40.284 |
| NT2NE20062880 | 0 | 0 | 0 | 100 |
| NT2NE20064780 | 0 | 0 | 0 | 100 |
| NT2NE20066590 | 0 | 0 | 0 | 100 |
| NT2NE20069580 | 0 | 0 | 0 | 59.083 |
| NT2NE20070520 | 0 | 0 | 0 | 100 |
| NT2NE20073650 | 0 | 0 | 0 | 100 |
| NT2NE20077250 | 0 | 0 | 0 | 100 |
| NT2NE20077270 | 0 | 0 | 0 | 100 |
| NT2NE20077860 | 0 | 0 | 0 | 100 |
| NT2NE20079670 | 0 | 0 | 0 | 100 |
| NT2NE20080770 | 0 | 0 | 0 | 100 |
| NT2NE20082130 | 0 | 0 | 0 | 38.09 |
| NT2NE20082600 | 0 | 0 | 0 | 66.235 |
| NT2NE20086070 | 0 | 0 | 0 | 100 |
| NT2NE20087270 | 0 | 0 | 0 | 100 |
| NT2NE20087850 | 0 | 0 | 0 | 100 |
| NT2NE20088030 | 0 | 0 | 0 | 60.425 |
| NT2NE20092950 | 0 | 20.298 | 0 | 20.87 |
| NT2NE20095230 | 0 | 0 | 0 | 55.188 |
| NT2NE20104000 | 0 | 0 | 0 | 100 |
| NT2NE20107810 | 0 | 0 | 0 | 100 |
| NT2NE20108420 | 0 | 0 | 0 | 45.407 |
| NT2NE20111190 | 0 | 0 | 0 | 61.289 |
| NT2NE20112210 | 0 | 0 | 0 | 26.669 |
| NT2NE20114850 | 0 | 0 | 0 | 100 |
| NT2NE20117580 | 0 | 0 | 0 | 100 |
| NT2NE20119980 | 0 | 0 | 0 | 100 |
| NT2NE20123610 | 0 | 0 | 0 | 100 |
| NT2NE20124570 | 0 | 0 | 0 | 100 |
| NT2NE20126030 | 0 | 0 | 0 | 100 |
| NT2NE20127900 | 0 | 0 | 16.514 | 25.025 |
| NT2NE20140130 | 0 | 0 | 0 | 100 |
| NT2NE20140280 | 0 | 0 | 0 | 100 |
| NT2NE20141040 | 0 | 0 | 0 | 36.013 |
| NT2NE20145250 | 0 | 0 | 0 | 100 |
| NT2NE20146510 | 0 | 0 | 0 | 100 |
| NT2NE20148690 | 0 | 0 | 0 | 67.567 |
| NT2NE20149500 | 0 | 0 | 0 | 100 |
| NT2NE20150610 | 0 | 0 | 0 | 100 |
| NT2NE20152620 | 0 | 0 | 0 | 100 |
| NT2NE20153620 | 0 | 0 | 0 | 60.858 |
| NT2NE20155650 | 0 | 0 | 0 | 100 |
| NT2NE20157120 | 0 | 0 | 0 | 100 |
| NT2NE20165190 | 0 | 0 | 0 | 100 |
| NT2NE20167660 | 0 | 0 | 0 | 100 |
| NT2NE20173970 | 0 | 0 | 0 | 100 |
| NT2NE20177210 | 0 | 0 | 0 | 43.734 |
| NT2NE20181760 | 0 | 0 | 0 | 100 |
| NT2NE20181800 | 0 | 0 | 0 | 46.215 |
| NT2NE20184720 | 0 | 0 | 0 | 100 |
| NT2RI20016240 | 0 | 0 | 100 | 0 |
| NT2RI20021200 | 0 | 0 | 8.844 | 0 |
| NT2RI20033920 | 0 | 0 | 100 | 0 |
| NT2RI20093010 | 0 | 0 | 100 | 0 |
| NT2RP70001120 | 0 | 32.573 | 0 | 0 |
| NT2RP70001730 | 0 | 15.462 | 0 | 0 |
| NT2RP70003110 | 0 | 24.333 | 0 | 0 |
| NT2RP70012830 | 0 | 5.639 | 0 | 5.798 |
| NT2RP70022820 | 0 | 66.955 | 0 | 0 |
| NT2RP70027790 | 0 | 60.194 | 0 | 0 |
| NT2RP70029780 | 0 | 100 | 0 | 0 |
| NT2RP70030840 | 0 | 100 | 0 | 0 |
| NT2RP70031070 | 0 | 100 | 0 | 0 |
| NT2RP70031340 | 0 | 100 | 0 | 0 |
| NT2RP70031480 | 0 | 100 | 0 | 0 |
| NT2RP70035110 | 0 | 23.442 | 0 | 0 |
| NT2RP70046410 | 0 | 64.358 | 0 | 0 |
| NT2RP70049610 | 0 | 100 | 0 | 0 |
| NT2RP70056290 | 0 | 100 | 0 | 0 |
| NT2RP70056690 | 0 | 100 | 0 | 0 |
| NT2RP70057500 | 0 | 13.6 | 0 | 0 |
| NT2RP70064570 | 0 | 60.194 | 0 | 0 |
| NT2RP70074800 | 0 | 100 | 0 | 0 |
| NT2RP70075300 | 0 | 6.726 | 0 | 0 |
| NT2RP70075800 | 0 | 100 | 0 | 0 |
| NT2RP70080150 | 0 | 100 | 0 | 0 |
| NT2RP70084540 | 0 | 100 | 0 | 0 |
| NT2RP70087140 | 0 | 7.444 | 15.153 | 7.654 |
| NT2RP70090870 | 0 | 17.122 | 11.617 | 0 |
| OCBBF20001780 | 0 | 0 | 15.351 | 0 |
| OCBBF20009820 | 84.348 | 0 | 0 | 0 |
| OCBBF20142290 | 0 | 0 | 0 | 14.577 |
| OCBBF20155030 | 0 | 49.439 | 0 | 0 |
| OCBBF20175360 | 0 | 0 | 0 | 20.881 |
| OCBBF20177540 | 0 | 25.509 | 0 | 0 |
| OCBBF20177910 | 0 | 0 | 23.505 | 0 |
| PLACE60054820 | 0 | 0 | 20.089 | 0 |
| PLACE60061370 | 0 | 18.07 | 0 | 0 |
| PLACE60073090 | 0 | 10.617 | 0 | 0 |
| PLACE60162100 | 0 | 0 | 0 | 37.629 |
| PROST20011800 | 0 | 0 | 0 | 50.542 |
| PROST20045700 | 0 | 0 | 0 | 44.59 |
| PROST20078710 | 0 | 0 | 0 | 33.633 |
| PROST20094000 | 0 | 0 | 18.34 | 0 |
| PUAEN10000650 | 0 | 3.375 | 0 | 0 |
| PUAEN10001640 | 0 | 5.216 | 3.539 | 0 |
| SKNMC20006350 | 0 | 2.005 | 2.041 | 4.124 |
| SMINT20016150 | 0 | 49.972 | 0 | 0 |
| SMINT20030740 | 0 | 5.712 | 0 | 0 |
| SMINT20035510 | 0 | 0 | 28.984 | 0 |
| SMINT20039050 | 0 | 0 | 18.576 | 9.383 |
| SMINT20047290 | 0 | 39.6 | 0 | 0 |
| SPLEN20063250 | 0 | 8.081 | 8.225 | 8.309 |
| SPLEN20117580 | 0 | 0 | 0 | 24.462 |
| SPLEN20125230 | 0 | 0 | 21.559 | 0 |
| TESTI20030610 | 0 | 0 | 0 | 12.205 |
| TESTI20043910 | 0 | 0 | 0 | 45.963 |
| TESTI20066280 | 0 | 0 | 0 | 30.676 |
| TESTI20067480 | 0 | 8.861 | 0 | 0 |
| TESTI20105130 | 0 | 0 | 0 | 2.5 |
| TESTI20106170 | 0 | 13.104 | 0 | 0 |
| TESTI20143180 | 0 | 0 | 62.741 | 0 |
| TESTI20221790 | 0 | 0 | 39.167 | 0 |
| TESTI20254090 | 0 | 0 | 0 | 19.063 |
| TESTI20274960 | 0 | 0 | 38.685 | 0 |
| THYMU10004280 | 0 | 3.573 | 0 | 0 |
| THYMU20007020 | 0 | 0 | 71.017 | 0 |
| THYMU20104480 | 0 | 0 | 29.694 | 0 |
| THYMU20139160 | 0 | 1.822 | 0.618 | 0 |
| TRACH20026640 | 0 | 0 | 7.476 | 0 |
| UTERU10001060 | 0 | 0 | 19.967 | 0 |
| UTERU20026620 | 0 | 10.41 | 0 | 10.703 |
| UTERU20079240 | 0 | 0 | 0 | 19.734 |
| UTERU20083020 | 0 | 7.182 | 0 | 0 |
| UTERU20102260 | 0 | 0 | 0 | 23.706 |
| UTERU20132620 | 0 | 48.06 | 0 | 0 |

TABLE 5

| Clone ID | BEAST | TBAES |
|---|---|---|
| CTONG20070780 | 0 | 97.283 |
| CTONG20084660 | 0 | 89.108 |
| HLUNG20045340 | 0 | 85.362 |
| TESTI20047370 | 0 | 71.55 |

TABLE 6

| Clone ID | CERVX | TCERX |
|---|---|---|
| SMINT20030740 | 0 | 65.795 |

TABLE 7

| Clone ID | COLON | TCOLN |
|---|---|---|
| UTERU2004037 | 68.149 | 0 |

TABLE 8

| Clone ID | NESOP | TESOP |
|---|---|---|
| HLUNG20015180 | 51.695 | 0 |
| NESOP20004520 | 100 | 0 |
| NESOP20005040 | 100 | 0 |
| TESOP10000350 | 0 | 86.127 |
| TESOP10001600 | 0 | 100 |
| THYMU20071120 | 0 | 81.712 |

TABLE 9

| Clone ID | KIDNE | TKIDN |
|---|---|---|
| ASTRO20009140 | 19.518 | 0 |
| ASTRO20027330 | 0 | 30.903 |
| ASTRO20055930 | 0 | 36.981 |
| BGGI120010750 | 4.532 | 0 |
| BNGH420074600 | 0 | 11.358 |
| BRACE20050870 | 0 | 15.884 |
| BRACE20054480 | 29.719 | 0 |
| BRACE20062580 | 2.613 | 0 |
| BRACE20219360 | 59.494 | 0 |
| BRAMY20003540 | 4.676 | 0 |
| BRAMY20003880 | 16.882 | 41.527 |
| BRAMY20043630 | 3.51 | 0 |
| BRAMY20055760 | 0 | 65.196 |
| BRAMY20125360 | 0 | 32.672 |
| BRAMY20190550 | 0 | 19.772 |
| BRAMY20204270 | 3.618 | 0 |
| BRAMY20227860 | 0 | 4.255 |
| BRAWH20014590 | 0 | 23.509 |
| BRAWH20093070 | 0 | 14.759 |
| BRHIP10001040 | 0 | 5.496 |
| CTONG20033750 | 59.93 | 0 |
| CTONG20039370 | 59.93 | 0 |
| CTONG20045500 | 59.93 | 0 |
| CTONG20079590 | 0 | 17.392 |
| FCBBF20023490 | 14.59 | 0 |
| FCBBF30004340 | 0 | 10.386 |
| FCBBF30106950 | 0 | 69.888 |
| FCBBF30115230 | 0 | 69.888 |
| FCBBF30169280 | 0 | 38.857 |
| FCBBF30225930 | 0 | 50.898 |
| FCBBF30282020 | 0 | 53.714 |
| FEBRA20038330 | 0 | 6.538 |
| FEBRA20039260 | 7.084 | 0 |
| FEBRA20040290 | 7.711 | 0 |
| FEBRA20082660 | 0 | 77.359 |
| FEBRA20121200 | 0 | 63.078 |
| FEBRA20170240 | 0 | 63.078 |
| HEART10001490 | 20.269 | 0 |
| HLUNG20041590 | 4.744 | 0 |
| HLUNG20068120 | 11.84 | 0 |
| HLUNG20072450 | 3.599 | 0 |
| HLUNG20083480 | 0 | 15.004 |
| HLUNG20083960 | 18.946 | 0 |
| KIDNE20011600 | 100 | 0 |
| KIDNE20016360 | 59.589 | 0 |
| KIDNE20024380 | 100 | 0 |
| KIDNE20027980 | 100 | 0 |
| KIDNE20080690 | 5.861 | 0 |
| KIDNE20081170 | 100 | 0 |
| KIDNE20083150 | 100 | 0 |
| KIDNE20083620 | 100 | 0 |
| KIDNE20084030 | 40.03 | 0 |
| KIDNE20084040 | 34.084 | 0 |

TABLE 9-continued

| Clone ID | KIDNE | TKIDN |
|---|---|---|
| KIDNE20084730 | 100 | 0 |
| KIDNE20084800 | 100 | 0 |
| KIDNE20086490 | 87.61 | 0 |
| KIDNE20086660 | 47.013 | 0 |
| KIDNE20086970 | 100 | 0 |
| KIDNE20087880 | 28.683 | 0 |
| KIDNE20088240 | 100 | 0 |
| KIDNE20089870 | 3.987 | 0 |
| KIDNE20091090 | 100 | 0 |
| KIDNE20094260 | 100 | 0 |
| KIDNE20094670 | 59.494 | 0 |
| KIDNE20095530 | 100 | 0 |
| KIDNE20133460 | 100 | 0 |
| KIDNE20133880 | 100 | 0 |
| KIDNE20134130 | 65.363 | 0 |
| KIDNE20134890 | 100 | 0 |
| KIDNE20137310 | 100 | 0 |
| KIDNE20138450 | 38.971 | 0 |
| KIDNE20140870 | 22.93 | 0 |
| KIDNE20141120 | 100 | 0 |
| KIDNE20141700 | 100 | 0 |
| KIDNE20142680 | 100 | 0 |
| KIDNE20142680 | 100 | 0 |
| KIDNE20142900 | 31.732 | 0 |
| KIDNE20143200 | 100 | 0 |
| KIDNE20147170 | 100 | 0 |
| KIDNE20148080 | 100 | 0 |
| KIDNE20149780 | 60.365 | 0 |
| KIDNE20150730 | 100 | 0 |
| KIDNE20152440 | 100 | 0 |
| KIDNE20154330 | 100 | 0 |
| KIDNE20154830 | 100 | 0 |
| KIDNE20155980 | 100 | 0 |
| KIDNE20157100 | 100 | 0 |
| KIDNE20160360 | 100 | 0 |
| KIDNE20160960 | 100 | 0 |
| KIDNE20163710 | 100 | 0 |
| KIDNE20165390 | 100 | 0 |
| KIDNE20169180 | 100 | 0 |
| KIDNE20170400 | 19.556 | 0. |
| KIDNE20173150 | 100 | 9 |
| KIDNE20173430 | 36.673 | 0 |
| KIDNE20176030 | 100 | 0 |
| KIDNE20181670 | 100 | 0 |
| KIDNE20182540 | 100 | 0 |
| KIDNE20186170 | 100 | 0 |
| KIDNE20188630 | 100 | 0 |
| KIDNE20189890 | 100 | 0 |
| KIDNE20189960 | 100 | 0 |
| KIDNE20191870 | 100 | 0 |
| MESAN20038520 | 0 | 11.358 |
| MESAN20041380 | 0 | 53.625 |
| OCBBF20016390 | 0 | 23.211 |
| OCBBF20142290 | 0 | 8.623 |
| OCBBF20174890 | 32.241 | 0 |
| PLACE60061370 | 0 | 21.981 |
| PLACE60073090 | 10.501 | 0 |
| PLACE60181870 | 49.921 | 0 |
| PROST20016760 | 3.992 | 9.82 |
| PUAEN10000650 | 6.676 | 0 |
| SMINT20039050 | 0 | 11.102 |
| SMINT20089210 | 0 | 12.885 |
| SPLEN20017610 | 42.429 | 0 |
| SPLEN20024930 | 0 | 22.541 |
| SPLEN20057830 | 0 | 35 |
| SPLEN20063250 | 3.996 | 0 |
| SPLEN20126110 | 50.05 | 0 |
| SPLEN20135030 | 31.695 | 0 |
| SPLEN20136700 | 0 | 39.807 |
| TESTI20070740 | 0 | 75.118 |
| TESTI20262150 | 40.96 | 0 |
| THYMU20009500 | 0 | 24.928 |
| THYMU20019260 | 0 | 36.869 |
| THYMU20157620 | 0 | 19.973 |

TABLE 9-continued

| Clone ID | KIDNE | TKIDN |
|---|---|---|
| TKIDN10000620 | 0 | 100 |
| TKIDN10001710 | 0 | 100 |
| TKIDN10001920 | 0 | 36.869 |
| TRACH20011010 | 10.647 | 0 |
| UMVEN10001380 | 0 | 4.196 |

TABLE 10

| Clone ID | LIVER | TLIVE |
|---|---|---|
| CTONG20069320 | 20.862 | 0 |
| FCBBF30236670 | 3.257 | 0 |
| FEBRA20038220 | 77.547 | 0 |
| FEBRA20039260 | 8.806 | 0 |
| KIDNE20087880 | 71.317 | 0 |
| LIVER20006260 | 100 | 0 |
| LIVER20007690 | 85.922 | 0 |
| LIVER20007750 | 100 | 0 |
| LIVER20010510 | 100 | 0 |
| LIVER20010760 | 100 | 0 |
| LIVER20010990 | 100 | 0 |
| LIVER20011640 | 100 | 0 |
| LIVER20013890 | 100 | 0 |
| LIVER20026440 | 100 | 0 |
| LIVER20030650 | 100 | 0 |
| LIVER20032340 | 100 | 0 |
| LIVER20038000 | 100 | 0 |
| LIVER20040740 | 100 | 0 |
| LIVER20055270 | 100 | 0 |
| MESAN20027240 | 21.684 | 0 |
| NT2RI20021200 | 16.028 | 0 |
| SKMUS20006790 | 6.063 | 0 |
| TESTI20035330 | 22.045 | 0 |
| THYMU10004280 | 8.787 | 4.346 |
| THYMU20029830 | 31.692 | 0 |

TABLE 11

| Clone ID | HLUNG | TLUNG |
|---|---|---|
| HLUNG20052300 | 23.611 | 0 |
| SMINT20035050 | 6.135 | 0 |
| HLUNG20041590 | 10.207 | 0 |
| PROST20016760 | 8.589 | 0 |
| BRAMY20043630 | 15.102 | 0 |
| HLUNG20015180 | 4.723 | 0 |
| THYMU20139160 | 1.939 | 0 |
| HLUNG20020850 | 67.488 | 0 |
| HLUNG20032460 | 44.037 | 0 |
| BRAMY20204270 | 7.785 | 0 |
| BRAMY20001510 | 5.948 | 0 |
| BRAMY20227860 | 1.488 | 0 |
| CTONG20029030 | 28.504 | 0 |
| CTONG20168460 | 76.291 | 0 |
| CTONG20186290 | 61.67 | 0 |
| FEBRA20039260 | 7.62 | 0 |
| FEBRA20078800 | 33.686 | 0 |
| FEBRA20163980 | 38.327 | 0 |
| HCHON20000870 | 23.288 | 0 |
| HLUNG20008460 | 67.54 | 0 |
| HLUNG20009260 | 100 | 0 |
| HLUNG20009550 | 100 | 0 |
| HLUNG20010130 | 100 | 0 |
| HLUNG20011260 | 100 | 0 |
| HLUNG20011440 | 100 | 0 |
| HLUNG20011460 | 76.577 | 0 |
| HLUNG20012140 | 100 | 0 |
| HLUNG20014590 | 36.045 | 0 |
| HLUNG20015070 | 17.804 | 0 |
| HLUNG20020500 | 100 | 0 |

TABLE 11-continued

| Clone ID | HLUNG | TLUNG |
|---|---|---|
| HLUNG20021450 | 68.006 | 0 |
| HLUNG20023030 | 100 | 0 |
| HLUNG20024050 | 100 | 0 |
| HLUNG20025620 | 100 | 0 |
| HLUNG20028110 | 76.618 | 0 |
| HLUNG20029420 | 100 | 0 |
| HLUNG20029490 | 81.173 | 0 |
| HLUNG20030420 | 100 | 0 |
| HLUNG20030490 | 100 | 0 |
| HLUNG20030610 | 100 | 0 |
| HLUNG20031620 | 80.237 | 0 |
| HLUNG20033060 | 36.529 | 0 |
| HLUNG20033310 | 100 | 0 |
| HLUNG20033350 | 100 | 0 |
| HLUNG20034970 | 79.349 | 0 |
| HLUNG20037140 | 100 | 0 |
| HLUNG20037160 | 100 | 0 |
| HLUNG20037780 | 44.761 | 0 |
| HLUNG20038330 | 100 | 0 |
| HLUNG20041540 | 100 | 0 |
| HLUNG20042730 | 100 | 0 |
| HLUNG20045340 | 7.67 | 0 |
| HLUNG20047070 | 100 | 0 |
| HLUNG20050760 | 100 | 0 |
| HLUNG20051330 | 100 | 0 |
| HLUNG20054790 | 100 | 0 |
| HLUNG20055240 | 100 | 0 |
| HLUNG20056560 | 75.961 | 0 |
| HLUNG20057380 | 100 | 0 |
| HLUNG20059240 | 100 | 0 |
| HLUNG20060670 | 100 | 0 |
| HLUNG20063700 | 100 | 0 |
| HLUNG20065700 | 62.8 | 0 |
| HLUNG20065990 | 100 | 0 |
| HLUNG20067810 | 100 | 0 |
| HLUNG20068120 | 50.947 | 0 |
| HLUNG20069350 | 100 | 0 |
| HLUNG20070410 | 100 | 0 |
| HLUNG20072100 | 54.241 | 0 |
| HLUNG20072190 | 79.349 | 0 |
| HLUNG20072450 | 7.744 | 0 |
| HLUNG20074330 | 100 | 0 |
| HLUNG20079310 | 100 | 0 |
| HLUNG20081390 | 66.429 | 0 |
| HLUNG20081530 | 100 | 0 |
| HLUNG20082350 | 100 | 0 |
| HLUNG20083330 | 100 | 0 |
| HLUNG20083480 | 13.123 | 0 |
| HLUNG20083840 | 100 | 0 |
| HLUNG20083960 | 40.76 | 0 |
| HLUNG20084790 | 100 | 0 |
| HLUNG20085210 | 50.993 | 0 |
| HLUNG20088750 | 100 | 0 |
| HLUNG20092530 | 100 | 0 |
| HLUNG20093030 | 100 | 0 |
| HLUNG20094130 | 75.987 | 0 |
| KIDNE20142900 | 68.268 | 0 |
| PROST20052850 | 57.701 | 0 |
| SKNMC20006350 | 2.134 | 0 |
| SPLEN20012450 | 25.695 | 0 |
| TESTI20057590 | 17.804 | 0 |
| TESTI20061200 | 29.123 | 0 |
| TESTI20067480 | 18.856 | 0 |
| TESTI20116050 | 30.168 | 0 |
| THYMU10004280 | 7.603 | 0 |
| THYMU20010180 | 79.349 | 0 |
| TRACH20011010 | 22.907 | 0 |
| UTERU20016580 | 43.64 | 0 |
| UTERU20127030 | 66.318 | 0 |

TABLE 12

| Clone ID | NOVAR | TOVAR |
|---|---|---|
| KIDNE20089870 | 91.868 | 0 |
| NT2RP70075300 | 76.633 | 0 |
| TESTI20132310 | 94.177 | 0 |

TABLE 13

| Clone ID | STOMA | TSTOM |
|---|---|---|
| BNGH420087430 | 0 | 91.629 |
| BRAMY20227860 | 1.35 | 0 |
| BRAWH20027250 | 42.096 | 0 |
| CTONG20174440 | 26.346 | 0 |
| FEBRA20090220 | 4.442 | 0 |
| PUAEN10000650 | 13.031 | 0 |
| SMINT20023110 | 72.094 | 0 |
| SMINT20030740 | 5.514 | 0 |
| SMINT20045890 | 34.092 | 0 |
| SPLEN20048800 | 2.011 | 0 |
| SPLEN20139360 | 79.641 | 0 |
| TESTI20063410 | 28.273 | 0 |
| TESTI20150920 | 33.158 | 0 |
| TRACH20026640 | 21.272 | 0 |
| UTERU20041970 | 0 | 72.886 |

TABLE 14

| Clone ID | UTERU | TUTER |
|---|---|---|
| ADRGL20020290 | 21.538 | 0 |
| BRACE20038920 | 10.185 | 0 |
| BRAMY20091230 | 39.224 | 0 |
| BRAMY20093490 | 62.465 | 0 |
| BRAMY20227860 | 2.268 | 0 |
| BRHIP20005060 | 61.644 | 0 |
| CTONG20069320 | 18.336 | 0 |
| CTONG20083430 | 62.039 | 0 |
| FCBBF30005360 | 41.409 | 0 |
| FCBBF30257370 | 21.099 | 0 |
| FEBRA20038330 | 5.808 | 0 |
| FEBRA20039260 | 7.74 | 0 |
| FEBRA20040260 | 43.146 | 0 |
| FEBRA20078180 | 31.447 | 0 |
| FEBRA20087550 | 10.505 | 0 |
| HLUNG20015070 | 9.042 | 0 |
| HLUNG20015180 | 7.196 | 0 |
| MESAN20007110 | 50.674 | 0 |
| MESAN20067430 | 20.114 | 0 |
| MESAN20095800 | 14.162 | 0 |
| NT2RP70057500 | 14.698 | 0 |
| SKMUS20008730 | 2.775 | 0 |
| SKNMC20006350 | 1.084 | 0 |
| SMINT20035050 | 3.116 | 0 |
| SMINT20045890 | 19.084 | 0 |
| SPLEN20073880 | 30.142 | 0 |
| SPLEN20076470 | 17.567 | 0 |
| SPLEN20118050 | 33.583 | 0 |
| TESTI20030610 | 12.829 | 0 |
| TESTI20035330 | 9.688 | 0 |
| TESTI20057590 | 9.042 | 0 |
| TESTI20059080 | 9.096 | 0 |
| TESTI20105130 | 0 | 57.51 |
| THYMU10004280 | 3.861 | 0 |
| THYMU20139160 | 1.969 | 21.546 |
| UTERU10001060 | 31.804 | 0 |
| UTERU10001870 | 100 | 0 |
| UTERU20000230 | 34.999 | 0 |
| UTERU20000950 | 3.88 | 0 |
| UTERU20011760 | 100 | 0 |
| UTERU20013890 | 100 | 0 |
| UTERU20016580 | 22.164 | 0 |

TABLE 14-continued

| Clone ID | UTERU | TUTER |
|---|---|---|
| UTERU20026620 | 33.752 | 0 |
| UTERU20027360 | 100 | 0 |
| UTERU20029930 | 72.842 | 0 |
| UTERU20031350 | 100 | 0 |
| UTERU20035770 | 100 | 0 |
| UTERU20040150 | 100 | 0 |
| UTERU20040370 | 6.264 | 0 |
| UTERU20040390 | 100 | 0 |
| UTERU20040730 | 100 | 0 |
| UTERU20041630 | 100 | 0 |
| UTERU20041970 | 6.578 | 0 |
| UTERU20045200 | 62.039 | 0 |
| UTERU20051790 | 100 | 0 |
| UTERU20064120 | 100 | 0 |
| UTERU20065470 | 50.58 | 0 |
| UTERU20079240 | 20.742 | 0 |
| UTERU20083020 | 7.762 | 0 |
| UTERU20086530 | 100 | 0 |
| UTERU20087070 | 100 | 0 |
| UTERU20087850 | 100 | 0 |
| UTERU20089300 | 27.655 | 0 |
| UTERU20089390 | 17.567 | 0 |
| UTERU20089620 | 100 | 0 |
| UTERU20090940 | 100 | 0 |
| UThRU20091470 | 100 | 0 |
| UTERU20094830 | 100 | 0 |
| UTERU20095100 | 39.739 | 0 |
| UTERU20099040 | 100 | 0 |
| UTERU20099510 | 100 | 0 |
| UTERU20101150 | 100 | 0 |
| UTERU20102260 | 24.918 | 0 |
| UTERU20103040 | 100 | 0 |
| UTERU20103200 | 51.815 | 0 |
| UTERU20104310 | 100 | 0 |
| UTERU20106510 | 100 | 0 |
| UTERU20121140 | 100 | 0 |
| UTERU20122520 | 51.33 | 0 |
| UTERU20125810 | 100 | 0 |
| UTERU20127030 | 33.682 | 0 |
| UTERU20127150 | 62.412 | 0 |
| UTERU20128560 | 36.129 | 0 |
| UTERU20132620 | 51.94 | 0 |
| UTERU20134830 | 100 | 0 |
| UTERU20139760 | 100 | 0 |
| UTERU20140010 | 100 | 0 |
| UTERU20167570 | 100 | 0 |
| UTERU20168960 | 100 | 0 |
| UTERU20169020 | 100 | 0 |
| UTERU20173030 | 100 | 0 |
| UTERU20176230 | 72.842 | 0 |
| UTERU20177150 | 100 | 0 |
| UTERU20181270 | 100 | 0 |
| UTERU20185220 | 100 | 0 |
| UTERU20188670 | 100 | 0 |
| UTERU20188840 | 40.303 | 0 |

TABLE 15

| Clone ID | NTONG | CTONG |
|---|---|---|
| ADRGL20023920 | 13.989 | 0 |
| BRACE20038920 | 0 | 24.929 |
| BRACE20050870 | 0 | 34.54 |
| BRACE20061620 | 63.015 | 0 |
| BRAMY20036530 | 21.217 | 0 |
| BRAMY20076130 | 0 | 6.434 |
| BRAMY20204270 | 0 | 2.419 |
| BRAMY20267780 | 0 | 4.633 |
| BRCAN10001680 | 14.71 | 0 |
| CTONG10000090 | 0 | 87.752 |
| CTONG20000340 | 0 | 100 |
| CTONG20002790 | 0 | 100 |
| CTONG20004110 | 0 | 100 |

TABLE 15-continued

| Clone ID | NTONG | CTONG |
|---|---|---|
| CTONG20004520 | 0 | 100 |
| CTONG20007660 | 0 | 100 |
| CTONG20008190 | 0 | 100 |
| CTONG20008460 | 0 | 100 |
| CTONG20015240 | 0 | 100 |
| CTONG20017490 | 0 | 100 |
| CTONG20020660 | 0 | 100 |
| CTONG20020950 | 0 | 100 |
| CTONG20027660 | 0 | 49.358 |
| CTONG20029030 | 0 | 44.292 |
| CTONG20030280 | 0 | 100 |
| CTONG20031150 | 0 | 100 |
| CTONG20031890 | 0 | 62.139 |
| CTONG20032930 | 0 | 29.763 |
| CTONG20033500 | 0 | 100 |
| CTONG20033610 | 0 | 57.263 |
| CTONG20033750 | 0 | 40.07 |
| CTONG20035240 | 0 | 55.786 |
| CTONG20036800 | 0 | 100 |
| CTONG20036990 | 0 | 100 |
| CTONG20039370 | 0 | 40.07 |
| CTONG20041150 | 0 | 100 |
| CTONG20041260 | 0 | 100 |
| CTONG20042640 | 0 | 100 |
| CTONG20044230 | 0 | 49.358 |
| CTONG20044870 | 0 | 74.685 |
| CTONG20045500 | 0 | 40.07 |
| CTONG20046690 | 0 | 100 |
| CTONG20049480 | 0 | 100 |
| CTONG20050490 | 0 | 100 |
| CTONG20051100 | 0 | 100 |
| CTONG20051450 | 0 | 100 |
| CTONG20052780 | 0 | 100 |
| CTONG20053990 | 0 | 100 |
| CTONG20055670 | 0 | 100 |
| CTONG20055850 | 0 | 24.814 |
| CTONG20056150 | 0 | 51.203 |
| CTONG20057750 | 0 | 100 |
| CTONG20057950 | 0 | 54.423 |
| CTONG20059130 | 0 | 72.445 |
| CTONG20060040 | 0 | 72.825 |
| CTONG20061290 | 0 | 100 |
| CTONG20062730 | 0 | 100 |
| CTONG20063770 | 0 | 62.139 |
| CTONG20063930 | 0 | 28.37 |
| CTONG20065240 | 0 | 100 |
| CTONG20065680 | 0 | 100 |
| CTONG20066110 | 0 | 37.292 |
| CTONG20068360 | 0 | 100 |
| CTONG20069320 | 0 | 11.22 |
| CTONG20069420 | 0 | 42.813 |
| CTONG20070090 | 0 | 100 |
| CTONG20070720 | 0 | 7.689 |
| CTONG20070780 | 0 | 2.717 |
| CTONG20070910 | 0 | 100 |
| CTONG20071040 | 0 | 32.374 |
| CTONG20071680 | 0 | 49.582 |
| CTONG20072930 | 0 | 100 |
| CTON020073990 | 0 | 100 |
| CTONG20074000 | 0 | 100 |
| CTONG20074170 | 0 | 55.786 |
| CTONG20074740 | 0 | 100 |
| CTONG20076230 | 0 | 100 |
| CTONG20076810 | 0 | 100 |
| CTONG20077760 | 0 | 100 |
| CTONG20078340 | 0 | 74.685 |
| CTONG20079590 | 0 | 9.455 |
| CTONG20080140 | 0 | 27.673 |
| CTONG20081840 | 0 | 100 |
| CTONG20083430 | 0 | 37.961 |
| CTONG20083980 | 0 | 100 |
| CTONG20084020 | 0 | 100 |
| CTONG20084660 | 0 | 2.488 |
| CTONG20085210 | 0 | 27.762 |
| CTONG20133720 | 18.528 | 46.879 |
| CTONG20165590 | 0 | 100 |
| CTONG20165750 | 0 | 11.978 |
| CTONG20166580 | 0 | 100 |
| CTONG20167750 | 0 | 100 |
| CTONG20168240 | 37.367 | 11.818 |
| CTONG20168460 | 0 | 23.709 |
| CTONG20169040 | 0 | 100 |
| CTONG20169530 | 0 | 100 |
| CTONG20170940 | 0 | 89.253 |
| CTONG20174290 | 0 | 100 |
| CTONG20174580 | 0 | 100 |
| CTONG20176040 | 0 | 100 |
| CTONG20179390 | 0 | 100 |
| CTONG20179890 | 0 | 100 |
| CTONG20179980 | 0 | 100 |
| CTONG20180620 | 0 | 100 |
| CTONG20180690 | 0 | 100 |
| CTONG20181350 | 0 | 100 |
| CTONG20183430 | 0 | 55.786 |
| CTONG20183830 | 0 | 22.718 |
| CTONG20184130 | 0 | 100 |
| CTONG20184830 | 0 | 100 |
| CTONG20186140 | 0 | 100 |
| CTONG20186290 | 0 | 38.33 |
| CTONG20186370 | 0 | 39.387 |
| CTONG20186520 | 0 | 100 |
| CTONG20186550 | 0 | 100 |
| CTONG20188080 | 43.151 | 6.824 |
| CTONG20189000 | 0 | 100 |
| CTONG20190290 | 0 | 100 |
| CTONG20190630 | 0 | 100 |
| FCBBF20070950 | 0 | 14.977 |
| FCBBF30001100 | 0 | 24.477 |
| FCBBF30175350 | 32.34 | 10.228 |
| FCBBF40005000 | 0 | 20.766 |
| FEBRA20027070 | 26.269 | 0 |
| FEBRA20038330 | 0 | 3.554 |
| FEBRA20039260 | 7.487 | 0 |
| FEBRA20040290 | 0 | 2.578 |
| FEBRA20046200 | 0 | 16.309 |
| FBBRA20063720 | 0 | 8.106 |
| FEBRA20078800 | 0 | 10.469 |
| FEBRA20090220 | 0 | 12.173 |
| HCHON20000870 | 0 | 7.237 |
| HLUNG20068120 | 25.03 | 0 |
| MESAN20008150 | 0 | 38.598 |
| MESAN20027900 | 0 | 17.599 |
| NT2NE20153620 | 0 | 39.142 |
| NT2RP70001730 | 0 | 4.09 |
| NT2RP70012830 | 0 | 3.729 |
| NT2RP70027790 | 0 | 39.806 |
| NT2RP70057500 | 0 | 8.993 |
| NT2RP70064570 | 0 | 39.806 |
| NT2RP70090870 | 35.801 | 0 |
| NTONG20002230 | 50.815 | 0 |
| NTONG20005310 | 100 | 0 |
| NTONG20017620 | 29.697 | 0 |
| NTONG20029850 | 100 | 0 |
| NTONG20031580 | 100 | 0 |
| NTONG20032100 | 100 | 0 |
| NTONG20034540 | 67.622 | 0 |
| NTONG20035150 | 80.903 | 0 |
| NTONG20043080 | 100 | 0 |
| NTONG20048440 | 100 | 0 |
| NTONG20049180 | 63.818 | 20.184 |
| NTONG20053630 | 100 | 0 |
| NTONG20053730 | 100 | 0 |
| NTONG20053910 | 100 | 0 |
| NTONG20055200 | 10.784 | 3.411 |
| NTONG20058010 | 100 | 0 |
| NTONG20058220 | 100 | 0 |
| OCBBF20110730 | 0 | 11.1 |
| OCBBF20177540 | 0 | 16.869 |
| OCBBF20177910 | 0 | 22.909 |
| PROST20016760 | 0 | 2.669 |
| PROST20042700 | 0 | 33.088 |
| PROST20050390 | 0 | 30.175 |
| PROST20063430 | 50.958 | 0 |
| PROST20130320 | 0 | 11.979 |
| PUAEN10000650 | 7.056 | 0 |

TABLE 15-continued

| Clone ID | NTONG | CTONG |
|---|---|---|
| PUAEN10001640 | 0 | 13.798 |
| PUAEN20003120 | 0 | 19.799 |
| SKMUS20006790 | 5.155 | 0 |
| SKNMC20006350 | 0 | 3.316 |
| SKNSH20007160 | 0 | 9.506 |
| SMINT20030740 | 0 | 5.666 |
| SMINT20035510 | 0 | 28.25 |
| SMINT20089210 | 0 | 7.005 |
| SPLEN20024930 | 0 | 12.254 |
| SPLEN20040780 | 0 | 20.5 |
| SPLEN20063250 | 0 | 8.016 |
| SPLEN20181570 | 0 | 4.523 |
| SPLEN20187490 | 0 | 23.141 |
| TESTI20047370 | 0 | 1.998 |
| TESTI20057880 | 0 | 15.357 |
| TESTI20064530 | 0 | 10.734 |
| TESTI20079980 | 0 | 8.166 |
| TESTI20105130 | 0 | 4.825 |
| TESTI20118460 | 63.366 | 0 |
| TESTI20121040 | 0 | 17.698 |
| TESTI20197290 | 0 | 62.139 |
| THYMU10004280 | 0 | 2.363 |
| THYMU20030460 | 14.321 | 4.53 |
| THYMU20055460 | 0 | 10.818 |
| THYMU20089900 | 0 | 37.939 |
| THYMU20121040 | 0 | 54.423 |
| THYMU20139160 | 1.905 | 4.82 |
| THYMU20145990 | 0 | 37.385 |
| TRACH20011010 | 0 | 28.476 |
| TRACH20090060 | 0 | 6.234 |
| UTERU20000230 | 0 | 21.416 |
| UTERU20000950 | 0 | 2.374 |
| UTERU20016580 | 0 | 13.562 |
| UTERU20045200 | 0 | 37.961 |
| UTERU20083020 | 15.017 | 0 |

TABLE 16

| Clone ID | FCBBF | FEBRA | OCBBF | BRACE | BRALZ | BRAMY | BRAWH | BRCAN | BRCOC | BRHIP | BRSSN | BRSTN | BRTHA |
|---|---|---|---|---|---|---|---|---|---|---|---|---|---|
| ADRGL20020290 | 0 | 0 | 0 | 0 | 0 | 12.942 | 0 | 0 | 0 | 0 | 0 | 0 | 0 |
| ADRGL20021910 | 0 | 0 | 0 | 0 | 0 | 21.897 | 0 | 0 | 0 | 22.674 | 0 | 0 | 0 |
| ADRGL20023920 | 0 | 0 | 0 | 4.505 | 0 | 0 | 0 | 0 | 0 | 0 | 0 | 0 | 0 |
| ADRGL20046760 | 8.812 | 35.914 | 0 | 0 | 0 | 0 | 0 | 0 | 0 | 0 | 0 | 0 | 0 |
| ADRGL20062330 | 0 | 0 | 0 | 0 | 0 | 0 | 0 | 0 | 28.364 | 0 | 0 | 0 | 0 |
| ADRGL20079060 | 0 | 0 | 0 | 0 | 0 | 0 | 28.364 | 0 | 0 | 0 | 0 | 0 | 0 |
| ASTRO20009140 | 0 | 0 | 0 | 0 | 0 | 0 | 21.998 | 0 | 0 | 0 | 0 | 0 | 0 |
| ASTRO20020240 | 0 | 0 | 0 | 0 | 0 | 38.79 | 0 | 0 | 0 | 0 | 0 | 0 | 0 |
| ASTRO20027330 | 0 | 0 | 25.981 | 0 | 0 | 0 | 0 | 0 | 0 | 17.083 | 0 | 0 | 0 |
| ASTRO20047510 | 0 | 0 | 0 | 0 | 0 | 0 | 0 | 0 | 0 | 0 | 0 | 49.891 | 0 |
| ASTRO20055530 | 0 | 10.089 | 28.982 | 0 | 0 | 9.201 | 0 | 0 | 0 | 0 | 0 | 0 | 0 |
| ASTRO20055570 | 0 | 0 | 0 | 0 | 0 | 0 | 38.844 | 0 | 0 | 0 | 0 | 0 | 0 |
| ASTRO20055930 | 31.867 | 0 | 0 | 0 | 0 | 0 | 0 | 0 | 0 | 0 | 0 | 0 | 0 |
| ASTRO20090680 | 0 | 0 | 0 | 0 | 0 | 0 | 0 | 0 | 0 | 33.707 | 0 | 0 | 0 |
| BGGI120010750 | 4.804 | 0 | 0 | 0 | 0 | 0 | 0 | 0 | 0 | 0 | 0 | 0 | 0 |
| BNGH420021680 | 0 | 0 | 0 | 10.084 | 0 | 0 | 0 | 0 | 0 | 0 | 0 | 0 | 0 |
| BNGH420023870 | 0 | 0 | 0 | 0 | 0 | 0 | 0 | 0 | 0 | 0 | 0 | 0 | 52.181 |
| BNGH420059680 | 8.889 | 0 | 0 | 0 | 0 | 0 | 0 | 0 | 0 | 0 | 0 | 0 | 0 |
| BNGH420074600 | 4.894 | 0 | 0 | 0 | 0 | 12.127 | 0 | 0 | 0 | 0 | 0 | 0 | 0 |
| BNGH420086030 | 0 | 0 | 0 | 0 | 0 | 8.414 | 0 | 8.433 | 0 | 0 | 0 | 0 | 0 |
| BRACE10000510 | 0 | 0 | 0 | 55.676 | 0 | 0 | 30.722 | 0 | 0 | 0 | 0 | 0 | 0 |
| BRACE20003310 | 0 | 0 | 0 | 29.513 | 0 | 48.856 | 0 | 0 | 0 | 0 | 0 | 0 | 0 |
| BRACE20007330 | 0 | 0 | 0 | 38.94 | 0 | 0 | 0 | 0 | 0 | 61.06 | 0 | 0 | 0 |
| BRACE20009050 | 0 | 0 | 0 | 100 | 0 | 0 | 0 | 0 | 0 | 0 | 0 | 0 | 0 |
| BRACE20014450 | 0 | 0 | 0 | 100 | 0 | 0 | 0 | 0 | 0 | 0 | 0 | 0 | 0 |
| BRACE20017790 | 43.768 | 0 | 0 | 56.232 | 0 | 0 | 0 | 0 | 0 | 0 | 0 | 0 | 0 |
| BRACE20018810 | 0 | 0 | 0 | 100 | 0 | 0 | 0 | 0 | 0 | 0 | 0 | 0 | 0 |
| BRACE20025820 | 0 | 0 | 0 | 50.035 | 0 | 0 | 0 | 0 | 0 | 49.965 | 0 | 0 | 0 |
| BRACE20038920 | 0 | 20.132 | 9.638 | 6.346 | 0 | 12.24 | 0 | 0 | 0 | 0 | 0 | 0 | 0 |
| BRACE20050870 | 6.844 | 0 | 26.708 | 8.793 | 0 | 0 | 0 | 0 | 0 | 0 | 0 | 0 | 0 |
| BRACE20051600 | 0 | 0 | 0 | 100 | 0 | 0 | 0 | 0 | 0 | 0 | 0 | 0 | 0 |
| BRACE20051930 | 0 | 0 | 0 | 100 | 0 | 0 | 0 | 0 | 0 | 0 | 0 | 0 | 0 |
| BRACE20052430 | 0 | 0 | 0 | 100 | 0 | 0 | 0 | 0 | 0 | 0 | 0 | 0 | 0 |
| BRACE20052530 | 0 | 0 | 0 | 19.237 | 0 | 0 | 0 | 0 | 0 | 0 | 0 | 0 | 80.763 |
| BRACE20054080 | 0 | 0 | 0 | 26.402 | 0 | 0 | 0 | 25.519 | 0 | 26.365 | 0 | 0 | 0 |
| BRACE20054480 | 0 | 0 | 0 | 40.468 | 0 | 0 | 0 | 0 | 0 | 0 | 0 | 0 | 0 |

TABLE 17

| | | | | | | | | | | | | | |
|---|---|---|---|---|---|---|---|---|---|---|---|---|---|
| BRACE20054600 | 0 | 0 | 0 | 100 | 0 | 0 | 0 | 0 | 0 | 0 | 0 | 0 | 0 |
| BRACE20055560 | 0 | 0 | 0 | 100 | 0 | 0 | 0 | 0 | 0 | 0 | 0 | 0 | 0 |
| BRACE20057870 | 0 | 0 | 0 | 100 | 0 | 0 | 0 | 0 | 0 | 0 | 0 | 0 | 0 |
| BRACE20059110 | 0 | 0 | 0 | 100 | 0 | 0 | 0 | 0 | 0 | 0 | 0 | 0 | 0 |
| BRACE20059810 | 0 | 0 | 0 | 100 | 0 | 0 | 0 | 0 | 0 | 0 | 0 | 0 | 0 |

TABLE 17-continued

| | | | | | | | | | | | | | |
|---|---|---|---|---|---|---|---|---|---|---|---|---|---|
| BRACE20061620 | 0 | 0 | 0 | 20.295 | 0 | 0 | 0 | 0 | 0 | 0 | 0 | 0 | 0 |
| BRACE20062580 | 1.385 | 13.17 | 0 | 3.558 | 2.709 | 0 | 2.945 | 1.72 | 2.655 | 0 | 5.58 | 0 | 0 |
| BRACE20063540 | 0 | 23.259 | 0 | 21.996 | 33.485 | 0 | 0 | 21.26 | 0 | 0 | 0 | 0 | 0 |
| BRACE20065470 | 0 | 0 | 0 | 100 | 0 | 0 | 0 | 0 | 0 | 0 | 0 | 0 | 0 |
| BRACE20066360 | 0 | 0 | 60.297 | 39.703 | 0 | 0 | 0 | 0 | 0 | 0 | 0 | 0 | 0 |
| BRACE20068710 | 0 | 0 | 0 | 100 | 0 | 0 | 0 | 0 | 0 | 0 | 0 | 0 | 0 |
| BRACE20069000 | 0 | 0 | 0 | 11.616 | 0 | 0 | 0 | 0 | 0 | 0 | 0 | 0 | 0 |
| BRACE20069110 | 0 | 0 | 0 | 100 | 0 | 0 | 0 | 0 | 0 | 0 | 0 | 0 | 0 |
| BRACE20069440 | 0 | 0 | 0 | 100 | 0 | 0 | 0 | 0 | 0 | 0 | 0 | 0 | 0 |
| BRACE20079200 | 0 | 0 | 0 | 100 | 0 | 0 | 0 | 0 | 0 | 0 | 0 | 0 | 0 |
| BRACE20079370 | 28.774 | 29.318 | 0 | 18.484 | 0 | 0 | 0 | 0 | 0 | 0 | 0 | 0 | 0 |
| BRACE20097540 | 0 | 0 | 0 | 100 | 0 | 0 | 0 | 0 | 0 | 0 | 0 | 0 | 0 |
| BRACE20098860 | 0 | 0 | 0 | 100 | 0 | 0 | 0 | 0 | 0 | 0 | 0 | 0 | 0 |
| BRACE20099070 | 0 | 0 | 0 | 100 | 0 | 0 | 0 | 0 | 0 | 0 | 0 | 0 | 0 |
| BRACE20194670 | 0 | 0 | 0 | 100 | 0 | 0 | 0 | 0 | 0 | 0 | 0 | 0 | 0 |
| BRACE20196180 | 0 | 0 | 0 | 100 | 0 | 0 | 0 | 0 | 0 | 0 | 0 | 0 | 0 |
| BRACE20196960 | 0 | 0 | 0 | 100 | 0 | 0 | 0 | 0 | 0 | 0 | 0 | 0 | 0 |
| BRACE20200770 | 0 | 0 | 0 | 100 | 0 | 0 | 0 | 0 | 0 | 0 | 0 | 0 | 0 |
| BRACE20200970 | 0 | 0 | 0 | 100 | 0 | 0 | 0 | 0 | 0 | 0 | 0 | 0 | 0 |
| BRACE20204670 | 0 | 0 | 0 | 6.427 | 0 | 0 | 0 | 0 | 0 | 0 | 0 | 0 | 0 |
| BRACE20205840 | 0 | 0 | 0 | 100 | 0 | 0 | 0 | 0 | 0 | 0 | 0 | 0 | 0 |
| BRACE20207420 | 0 | 0 | 0 | 100 | 0 | 0 | 0 | 0 | 0 | 0 | 0 | 0 | 0 |
| BRACE20212450 | 0 | 0 | 0 | 23.804 | 0 | 0 | 0 | 0 | 0 | 0 | 0 | 0 | 0 |
| BRACE20215410 | 0 | 0 | 0 | 26.992 | 0 | 26.03 | 0 | 0 | 0 | 0 | 0 | 0 | 0 |
| BRACE20216700 | 0 | 0 | 0 | 100 | 0 | 0 | 0 | 0 | 0 | 0 | 0 | 0 | 0 |
| BRACE20216950 | 0 | 0 | 0 | 100 | 0 | 0 | 0 | 0 | 0 | 0 | 0 | 0 | 0 |
| BRACE20219360 | 0 | 0 | 0 | 40.506 | 0 | 0 | 0 | 0 | 0 | 0 | 0 | 0 | 0 |
| BRAMY10000980 | 0 | 0 | 0 | 0 | 0 | 100 | 0 | 0 | 0 | 0 | 0 | 0 | 0 |
| BRAMY10001730 | 0 | 0 | 0 | 0 | 0 | 100 | 0 | 0 | 0 | 0 | 0 | 0 | 0 |
| BRAMY20000210 | 0 | 0 | 0 | 0 | 0 | 100 | 0 | 0 | 0 | 0 | 0 | 0 | 0 |
| BRAMY20000250 | 0 | 0 | 0 | 0 | 0 | 49.943 | 0 | 50.057 | 0 | 0 | 0 | 0 | 0 |
| BRAMY20001510 | 0 | 0 | 0 | 0 | 2.866 | 1.815 | 3.116 | 0 | 0 | 0 | 0 | 0 | 0 |

TABLE 18

| | | | | | | | | | | | | | |
|---|---|---|---|---|---|---|---|---|---|---|---|---|---|
| BRAMY20003540 | 4.956 | 0 | 0 | 3.184 | 0 | 3.07 | 10.541 | 6.155 | 0 | 9.538 | 0 | 4.824 | 0 |
| BRAMY20003880 | 0 | 0 | 0 | 0 | 0 | 11.085 | 19.028 | 0 | 0 | 11.478 | 0 | 0 | 0 |
| BRAMY20005080 | 0 | 0 | 0 | 0 | 0 | 19.453 | 33.393 | 0 | 0 | 0 | 0 | 30.564 | 0 |
| BRAMY20013670 | 0 | 0 | 0 | 0 | 0 | 100 | 0 | 0 | 0 | 0 | 0 | 0 | 0 |
| BRAMY20016780 | 0 | 0 | 0 | 0 | 0 | 100 | 0 | 0 | 0 | 0 | 0 | 0 | 0 |
| BRAMY20020440 | 0 | 0 | 0 | 0 | 0 | 100 | 0 | 0 | 0 | 0 | 0 | 0 | 0 |
| BRAMY20021580 | 0 | 0 | 0 | 0 | 0 | 100 | 0 | 0 | 0 | 0 | 0 | 0 | 0 |
| BRAMY20023390 | 0 | 0 | 0 | 0 | 0 | 100 | 0 | 0 | 0 | 0 | 0 | 0 | 0 |
| BRAMY20023640 | 0 | 0 | 0 | 0 | 0 | 100 | 0 | 0 | 0 | 0 | 0 | 0 | 0 |
| BRAMY20024790 | 0 | 0 | 0 | 0 | 0 | 38.893 | 0 | 0 | 0 | 0 | 0 | 61.107 | 0 |
| BRAMY20027390 | 0 | 0 | 0 | 0 | 0 | 100 | 0 | 0 | 0 | 0 | 0 | 0 | 0 |
| BRAMY20027990 | 0 | 0 | 0 | 0 | 0 | 100 | 0 | 0 | 0 | 0 | 0 | 0 | 0 |
| BRAMY20028530 | 0 | 0 | 0 | 0 | 0 | 100 | 0 | 0 | 0 | 0 | 0 | 0 | 0 |
| BRAMY20028620 | 0 | 0 | 0 | 0 | 0 | 100 | 0 | 0 | 0 | 0 | 0 | 0 | 0 |
| BRAMY20035380 | 0 | 0 | 0 | 0 | 0 | 100 | 0 | 0 | 0 | 0 | 0 | 0 | 0 |
| BRAMY20035830 | 9.114 | 0 | 0 | 0 | 0 | 22.586 | 0 | 0 | 0 | 0 | 0 | 0 | 0 |
| BRAMY20036530 | 0 | 0 | 0 | 0 | 0 | 13.18 | 0 | 0 | 0 | 0 | 0 | 0 | 0 |
| BRAMY20036810 | 0 | 0 | 0 | 0 | 0 | 61.711 | 0 | 0 | 0 | 0 | 0 | 0 | 0 |
| BRAMY20038980 | 0 | 0 | 0 | 0 | 0 | 100 | 0 | 0 | 0 | 0 | 0 | 0 | 0 |
| BRAMY20039290 | 61.747 | 0 | 0 | 0 | 0 | 38.253 | 0 | 0 | 0 | 0 | 0 | 0 | 0 |
| BRAMY20040580 | 0 | 0 | 0 | 0 | 0 | 100 | 0 | 0 | 0 | 0 | 0 | 0 | 0 |
| BRAMY20043520 | 0 | 0 | 0 | 0 | 0 | 100 | 0 | 0 | 0 | 0 | 0 | 0 | 0 |
| BRAMY20043630 | 1.86 | 0 | 3.629 | 0 | 0 | 2.304 | 0 | 0 | 0 | 0 | 0 | 0 | 0 |
| BRAMY20044920 | 0 | 0 | 0 | 0 | 0 | 100 | 0 | 0 | 0 | 0 | 0 | 0 | 0 |
| BRAMY20045210 | 0 | 0 | 0 | 0 | 0 | 29.335 | 0 | 0 | 0 | 0 | 0 | 0 | 0 |
| BRAMY20045420 | 0 | 0 | 0 | 0 | 0 | 100 | 0 | 0 | 0 | 0 | 0 | 0 | 0 |
| BRAMY20047560 | 0 | 0 | 0 | 0 | 0 | 24.533 | 0 | 0 | 0 | 0 | 0 | 0 | 0 |
| BRAMY20050640 | 0 | 0 | 0 | 0 | 0 | 100 | 0 | 0 | 0 | 0 | 0 | 0 | 0 |
| BRAMY20050940 | 0 | 0 | 0 | 0 | 0 | 100 | 0 | 0 | 0 | 0 | 0 | 0 | 0 |
| BRAMY20051820 | 0 | 0 | 0 | 0 | 0 | 100 | 0 | 0 | 0 | 0 | 0 | 0 | 0 |
| BRAMY20052440 | 0 | 0 | 0 | 0 | 0 | 53.973 | 0 | 0 | 0 | 0 | 0 | 0 | 0 |
| BRAMY20053910 | 0 | 0 | 0 | 0 | 0 | 100 | 0 | 0 | 0 | 0 | 0 | 0 | 0 |
| BRAMY20055760 | 0 | 0 | 0 | 0 | 0 | 34.804 | 0 | 0 | 0 | 0 | 0 | 0 | 0 |
| BRAMY20056620 | 0 | 0 | 0 | 0 | 0 | 100 | 0 | 0 | 0 | 0 | 0 | 0 | 0 |
| BRAMY20056840 | 0 | 0 | 0 | 0 | 0 | 100 | 0 | 0 | 0 | 0 | 0 | 0 | 0 |
| BRAMY20063750 | 0 | 0 | 0 | 0 | 0 | 53.973 | 0 | 0 | 0 | 0 | 0 | 0 | 0 |
| BRAMY20072440 | 0 | 17.768 | 0 | 16.803 | 0 | 32.409 | 0 | 16.241 | 0 | 16.78 | 0 | 0 | 0 |

TABLE 19

| | | | | | | | | | | | | | |
|---|---|---|---|---|---|---|---|---|---|---|---|---|---|
| BRAMY20072870 | 0 | 0 | 0 | 0 | 0 | 23.589 | 0 | 0 | 0 | 0 | 0 | 0 | 0 |
| BRAMY20073080 | 0 | 0 | 0 | 0 | 0 | 100 | 0 | 0 | 0 | 0 | 0 | 0 | 0 |
| BRAMY20074110 | 0 | 0 | 0 | 0 | 0 | 100 | 0 | 0 | 0 | 0 | 0 | 0 | 0 |
| BRAMY20074860 | 0 | 0 | 0 | 0 | 0 | 100 | 0 | 0 | 0 | 0 | 0 | 0 | 0 |
| BRAMY20076100 | 0 | 0 | 0 | 0 | 0 | 100 | 0 | 0 | 0 | 0 | 0 | 0 | 0 |
| BRAMY20076130 | 10.199 | 6.928 | 0 | 6.552 | 9.974 | 18.955 | 0 | 0 | 0 | 19.628 | 0 | 9.927 | 0 |
| BRAMY20076530 | 0 | 0 | 0 | 0 | 0 | 100 | 0 | 0 | 0 | 0 | 0 | 0 | 0 |
| BRAMY20083330 | 0 | 0 | 0 | 0 | 0 | 100 | 0 | 0 | 0 | 0 | 0 | 0 | 0 |
| BRAMY20083820 | 0 | 0 | 0 | 0 | 0 | 100 | 0 | 0 | 0 | 0 | 0 | 0 | 0 |
| BRAMY20089770 | 0 | 0 | 0 | 0 | 0 | 10.831 | 0 | 0 | 0 | 11.215 | 0 | 0 | 0 |
| BRAMY20091230 | 0 | 0 | 0 | 0 | 37.206 | 23.57 | 0 | 0 | 0 | 0 | 0 | 0 | 0 |
| BRAMY20093490 | 0 | 0 | 0 | 0 | 0 | 37.535 | 0 | 0 | 0 | 0 | 0 | 0 | 0 |
| BRAMY20094890 | 0 | 0 | 0 | 0 | 0 | 100 | 0 | 0 | 0 | 0 | 0 | 0 | 0 |
| BRAMY20095080 | 0 | 0 | 0 | 0 | 0 | 49.016 | 0 | 0 | 0 | 25.378 | 0 | 0 | 0 |
| BRAMY20095570 | 0 | 0 | 0 | 0 | 0 | 0 | 0 | 0 | 0 | 0 | 0 | 0 | |
| BRAMY20096930 | 0 | 0 | 0 | 0 | 0 | 100 | 0 | 0 | 0 | 0 | 0 | 0 | 0 |
| BRAMY20100680 | 0 | 0 | 0 | 0 | 0 | 100 | 0 | 0 | 0 | 0 | 0 | 0 | 0 |
| BRAMY20102900 | 0 | 0 | 0 | 0 | 0 | 100 | 0 | 0 | 0 | 0 | 0 | 0 | 0 |
| BRAMY20107980 | 0 | 0 | 0 | 0 | 0 | 100 | 0 | 0 | 0 | 0 | 0 | 0 | 0 |
| BRAMY20111780 | 0 | 0 | 0 | 0 | 0 | 100 | 0 | 0 | 0 | 0 | 0 | 0 | 0 |
| BRAMY20117670 | 11.164 | 0 | 0 | 14.344 | 0 | 6.916 | 0 | 0 | 0 | 0 | 33.738 | 10.866 | 0 |
| BRAMY20118410 | 0 | 0 | 0 | 0 | 49.1280 | 0 | 50.872 | 0 | 0 | 0 | 0 | 0 | 0 |
| BRAMY20118490 | 0 | 0 | 0 | 0 | 0 | 49.128 | 0 | 0 | 0 | 50.872 | 0 | 0 | 0 |
| BRAMY20120170 | 0 | 0 | 0 | 0 | 0 | 100 | 0 | 0 | 0 | 0 | 0 | 0 | 0 |
| BRAMY20123400 | 0 | 0 | 0 | 0 | 0 | 49.128 | 0 | 0 | 0 | 50.872 | 0 | 0 | 0 |
| BRAMY20124970 | 0 | 0 | 0 | 0 | 0 | 100 | 0 | 0 | 0 | 0 | 0 | 0 | 0 |
| BRAMY20125170 | 0 | 52.301 | 0 | 0 | 0 | 47.699 | 0 | 0 | 0 | 0 | 0 | 0 | 0 |
| BRAMY20125360 | 0 | 0 | 0 | 0 | 0 | 17.442 | 0 | 17.481 | 26.994 | 0 | 0 | 0 | 0 |
| BRAMY20125550 | 0 | 0 | 0 | 0 | 0 | 100 | 0 | 0 | 0 | 0 | 0 | 0 | 0 |
| BRAMY20126910 | 0 | 0 | 0 | 0 | 0 | 100 | 0 | 0 | 0 | 0 | 0 | 0 | 0 |
| BRAMY20127310 | 0 | 0 | 0 | 0 | 0 | 100 | 0 | 0 | 0 | 0 | 0 | 0 | 0 |
| BRAMY20127760 | 0 | 0 | 0 | 0 | 0 | 100 | 0 | 0 | 0 | 0 | 0 | 0 | 0 |
| BRAMY20134050 | 0 | 0 | 0 | 0 | 0 | 100 | 0 | 0 | 0 | 0 | 0 | 0 | 0 |
| BRAMY20135720 | 0 | 0 | 0 | 0 | 0 | 100 | 0 | 0 | 0 | 0 | 0 | 0 | 0 |
| BRAMY20137360 | 0 | 0 | 0 | 0 | 0 | 100 | 0 | 0 | 0 | 0 | 0 | 0 | 0 |
| BRAMY20139440 | 0 | 0 | 0 | 0 | 0 | 100 | 0 | 0 | 0 | 0 | 0 | 0 | 0 |
| BRAMY20139750 | 0 | 0 | 0 | 0 | 0 | 100 | 0 | 0 | 0 | 0 | 0 | 0 | 0 |

TABLE 20

| | | | | | | | | | | | | | |
|---|---|---|---|---|---|---|---|---|---|---|---|---|---|
| BRAMY20143870 | 0 | 0 | 0 | 0 | 0 | 100 | 0 | 0 | 0 | 0 | 0 | 0 | 0 |
| BRAMY20152510 | 17.703 | 0 | 0 | 0 | 0 | 21.934 | 37.651 | 0 | 0 | 22.713 | 0 | 0 | 0 |
| BRAMY20155500 | 0 | 0 | 0 | 0 | 0 | 53.973 | 0 | 0 | 0 | 0 | 0 | 0 | 0 |
| BRAMY20158550 | 0 | 0 | 0 | 0 | 0 | 100 | 0 | 0 | 0 | 0 | 0 | 0 | 0 |
| BRAMY20159250 | 0 | 0 | 0 | 0 | 0 | 100 | 0 | 0 | 0 | 0 | 0 | 0 | 0 |
| BRAMY20160020 | 0 | 0 | 0 | 0 | 0 | 100 | 0 | 0 | 0 | 0 | 0 | 0 | 0 |
| BRAMY20173480 | 0 | 0 | 0 | 0 | 0 | 100 | 0 | 0 | 0 | 0 | 0 | 0 | 0 |
| BRAMY20190550 | 0 | 0 | 0 | 0 | 0 | 5.278 | 0 | 5.289 | 0 | 5.465 | 8.581 | 8.292 | 0 |
| BRAMY20194680 | 0 | 0 | 0 | 0 | 0 | 100 | 0 | 0 | 0 | 0 | 0 | 0 | 0 |
| BRAMY20204270 | 0 | 2.605 | 0 | 0 | 3.75 | 4.752 | 4.078 | 2.381 | 0 | 2.46 | 0 | 7.465 | 0 |
| BRAMY20206340 | 0 | 0 | 0 | 0 | 0 | 100 | 0 | 0 | 0 | 0 | 0 | 0 | 0 |
| BRAMY20219620 | 0 | 0 | 0 | 0 | 0 | 100 | 0 | 0 | 0 | 0 | 0 | 0 | 0 |
| BRAMY20221600 | 0 | 0 | 0 | 0 | 0 | 53.973 | 0 | 0 | 0 | 0 | 0 | 0 | 0 |
| BRAMY20223010 | 0 | 0 | 0 | 0 | 0 | 100 | 0 | 0 | 0 | 0 | 0 | 0 | 0 |
| BRAMY20225250 | 0 | 0 | 0 | 0 | 0 | 100 | 0 | 0 | 0 | 0 | 0 | 0 | 0 |
| BRAMY20225320 | 0 | 0 | 0 | 0 | 0 | 100 | 0 | 0 | 0 | 0 | 0 | 0 | 0 |
| BRAMY20227230 | 0 | 0 | 0 | 0 | 0 | 100 | 0 | 0 | 0 | 0 | 0 | 0 | 0 |
| BRAMY20227860 | 1.466 | 1.494 | 0.715 | 1.884 | 2.151 | 8.177 | 6.238 | 5.919 | 4.218 | 9.408 | 2.216 | 0 | 1.978 |
| BRAMY20227960 | 44.662 | 0 | 0 | 0 | 0 | 55.338 | 0 | 0 | 0 | 0 | 0 | 0 | 0 |
| BRAMY20231150 | 0 | 0 | 0 | 0 | 0 | 49.128 | 0 | 0 | 0 | 50.872 | 0 | 0 | 0 |
| BRAMY20234820 | 0 | 0 | 0 | 0 | 0 | 100 | 0 | 0 | 0 | 0 | 0 | 0 | 0 |
| BRAMY20237190 | 0 | 0 | 0 | 0 | 0 | 19.827 | 0 | 0 | 0 | 0 | 0 | 0 | 0 |
| BRAMY20238630 | 0 | 0 | 0 | 0 | 0 | 100 | 0 | 0 | 0 | 0 | 0 | 0 | 0 |
| BRAMY20243120 | 0 | 0 | 0 | 0 | 0 | 100 | 0 | 0 | 0 | 0 | 0 | 0 | 0 |
| BRAMY20244490 | 0 | 0 | 0 | 0 | 0 | 100 | 0 | 0 | 0 | 0 | 0 | 0 | 0 |
| BRAMY20245140 | 0 | 0 | 0 | 0 | 0 | 100 | 0 | 0 | 0 | 0 | 0 | 0 | 0 |
| BRAMY20245350 | 0 | 0 | 0 | 0 | 0 | 100 | 0 | 0 | 0 | 0 | 0 | 0 | 0 |
| BRAMY20245760 | 0 | 0 | 0 | 0 | 0 | 100 | 0 | 0 | 0 | 0 | 0 | 0 | 0 |
| BRAMY20251210 | 0 | 0 | 0 | 0 | 0 | 49.943 | 0 | 50.057 | 0 | 0 | 0 | 0 | 0 |
| BRAMY20251750 | 0 | 0 | 0 | 0 | 0 | 100 | 0 | 0 | 0 | 0 | 0 | 0 | 0 |
| BRAMY20263000 | 0 | 0 | 0 | 0 | 0 | 100 | 0 | 0 | 0 | 0 | 0 | 0 | 0 |
| BRAMY20267780 | 1.836 | 0 | 0 | 0 | 0 | 2.275 | 0 | 0 | 0 | 0 | 0 | 0 | 0 |
| BRAMY20269040 | 0 | 0 | 0 | 0 | 0 | 100 | 0 | 0 | 0 | 0 | 0 | 0 | 0 |
| BRAMY20271140 | 0 | 0 | 0 | 0 | 0 | 100 | 0 | 0 | 0 | 0 | 0 | 0 | 0 |

TABLE 20-continued

| | | | | | | | | | | | | | |
|---|---|---|---|---|---|---|---|---|---|---|---|---|---|
| BRAMY20274510 | 0 | 0 | 0 | 0 | 0 | 100 | 0 | 0 | 0 | 0 | 0 | 0 | 0 |
| BRAMY20285650 | 0 | 0 | 0 | 0 | 0 | 61.711 | 0 | 0 | 0 | 0 | 0 | 0 | 0 |
| BRAMY20287400 | 0 | 0 | 0 | 0 | 0 | 100 | 0 | 0 | 0 | 0 | 0 | 0 | 0 |

TABLE 21

| | | | | | | | | | | | | | |
|---|---|---|---|---|---|---|---|---|---|---|---|---|---|
| BRAWH20014590 | 0 | 0 | 0 | 0 | 0 | 0 | 43.087 | 0 | 0 | 12.996 | 20.407 | 0 | 0 |
| BRAWH20020470 | 0 | 0 | 0 | 37.659 | 0 | 0 | 62.341 | 0 | 0 | 0 | 0 | 0 | 0 |
| BRAWH20020600 | 0 | 0 | 0 | 0 | 0 | 0 | 100 | 0 | 0 | 0 | 0 | 0 | 0 |
| BRAWH20021910 | 0 | 0 | 0 | 0 | 0 | 0 | 100 | 0 | 0 | 0 | 0 | 0 | 0 |
| BRAWH20025490 | 0 | 0 | 0 | 0 | 0 | 0 | 52.588 | 0 | 47.412 | 0 | 0 | 0 | 0 |
| BRAWH20026010 | 0 | 0 | 0 | 0 | 0 | 0 | 27.777 | 16.218 | 0 | 0 | 0 | 0 | 0 |
| BRAWH20027250 | 0 | 0 | 0 | 0 | 0 | 0 | 24.306 | 0 | 0 | 0 | 0 | 0 | 0 |
| BRAWH20030000 | 0 | 0 | 0 | 0 | 0 | 0 | 100 | 0 | 0 | 0 | 0 | 0 | 0 |
| BRAWH20039640 | 0 | 0 | 0 | 0 | 0 | 0 | 100 | 0 | 0 | 0 | 0 | 0 | 0 |
| BRAWH20040680 | 0 | 0 | 0 | 0 | 0 | 0 | 100 | 0 | 0 | 0 | 0 | 0 | 0 |
| BRAWH20047790 | 0 | 0 | 0 | 0 | 0 | 0 | 100 | 0 | 0 | 0 | 0 | 0 | 0 |
| BRAWH20050740 | 31.981 | 0 | 0 | 0 | 0 | 0 | 68.019 | 0 | 0 | 0 | 0 | 0 | 0 |
| BRAWH20055240 | 0 | 0 | 0 | 0 | 0 | 0 | 100 | 0 | 0 | 0 | 0 | 0 | 0 |
| BRAWH20055330 | 0 | 0 | 0 | 0 | 0 | 0 | 100 | 0 | 0 | 0 | 0 | 0 | 0 |
| BRAWH20055780 | 0 | 0 | 0 | 0 | 0 | 0 | 45.321 | 0 | 0 | 54.679 | 0 | 0 | 0 |
| BRAWH20058120 | 0 | 0 | 0 | 0 | 0 | 0 | 100 | 0 | 0 | 0 | 0 | 0 | 0 |
| BRAWH20063010 | 0 | 0 | 0 | 0 | 0 | 0 | 100 | 0 | 0 | 0 | 0 | 0 | 0 |
| BRAWH20078080 | 0 | 0 | 0 | 0 | 0 | 0 | 100 | 0 | 0 | 0 | 0 | 0 | 0 |
| BRAWH20078620 | 0 | 0 | 0 | 0 | 0 | 0 | 100 | 0 | 0 | 0 | 0 | 0 | 0 |
| BRAWH20080580 | 0 | 0 | 47.847 | 0 | 0 | 0 | 52.153 | 0 | 0 | 0 | 0 | 0 | 0 |
| BRAWH20082550 | 4.964 | 0 | 9.686 | 0 | 0 | 6.151 | 10.558 | 0 | 0 | 0 | 0 | 0 | 0 |
| BRAWH20082920 | 0 | 0 | 0 | 0 | 0 | 0 | 69.313 | 0 | 0 | 0 | 0 | 0 | 0 |
| BRAWH20093040 | 0 | 0 | 0 | 0 | 0 | 0 | 29.619 | 0 | 26.704 | 0 | 0 | 0 | 0 |
| BRAWH20093070 | 0 | 0 | 0 | 24.51 | 0 | 0 | 27.05 | 0 | 0 | 8.159 | 0 | 0 | 0 |
| BRAWH20094900 | 0 | 0 | 0 | 37.659 | 0 | 0 | 62.341 | 0 | 0 | 0 | 0 | 0 | 0 |
| BRAWH20095900 | 0 | 0 | 0 | 0 | 0 | 36.811 | 63.189 | 0 | 0 | 0 | 0 | 0 | 0 |
| BRAWH20173790 | 0 | 0 | 0 | 0 | 0 | 23.285 | 39.971 | 0 | 0 | 0 | 0 | 0 | 0 |
| BRAWH20174330 | 0 | 0 | 0 | 0 | 0 | 0 | 100 | 0 | 0 | 0 | 0 | 0 | 0 |
| BRAWH20175230 | 0 | 0 | 0 | 0 | 0 | 0 | 100 | 0 | 0 | 0 | 0 | 0 | 0 |
| BRAWH20175340 | 0 | 0 | 0 | 0 | 0 | 0 | 100 | 0 | 0 | 0 | 0 | 0 | 0 |
| BRAWH20176850 | 0 | 0 | 29.749 | 0 | 0 | 18.89 | 32.427 | 18.933 | 0 | 0 | 0 | 0 | 0 |
| BRAWH20182670 | 0 | 0 | 0 | 0 | 0 | 0 | 100 | 0 | 0 | 0 | 0 | 0 | 0 |
| BRAWH20183170 | 0 | 0 | 0 | 0 | 0 | 0 | 100 | 0 | 0 | 0 | 0 | 0 | 0 |
| BRAWH20185260 | 0 | 0 | 0 | 0 | 0 | 36.811 | 63.189 | 0 | 0 | 0 | 0 | 0 | 0 |
| BRAWH20185270 | 0 | 0 | 0 | 0 | 0 | 0 | 35.8 | 0 | 0 | 0 | 0 | 0 | 0 |
| BRAWH20186010 | 0 | 0 | 0 | 0 | 0 | 0 | 100 | 0 | 0 | 0 | 0 | 0 | 0 |
| BRAWH20188750 | 0 | 0 | 0 | 0 | 0 | 0 | 100 | 0 | 0 | 0 | 0 | 0 | 0 |

TABLE 22

| | | | | | | | | | | | | | |
|---|---|---|---|---|---|---|---|---|---|---|---|---|---|
| BRAWH20190530 | 0 | 0 | 0 | 0 | 0 | 0 | 100 | 0 | 0 | 0 | 0 | 0 | 0 |
| BRAWH20190550 | 0 | 0 | 0 | 0 | 0 | 0 | 100 | 0 | 0 | 0 | 0 | 0 | 0 |
| BRAWH20191980 | 0 | 0 | 0 | 37.659 | 0 | 0 | 62.341 | 0 | 0 | 0 | 0 | 0 | 0 |
| BRCAN10000760 | 0 | 0 | 0 | 0 | 0 | 0 | 0 | 6.922 | 0 | 0 | 0 | 0 | 0 |
| BRCAN10001050 | 0 | 0 | 0 | 0 | 0 | 0 | 100 | 0 | 0 | 0 | 0 | 0 | 0 |
| BRCAN10001680 | 0 | 5.009 | 0 | 0 | 0 | 9.137 | 0 | 13.737 | 0 | 14.193 | 0 | 14.356 | 0 |
| BRCAN20001480 | 0 | 0 | 0 | 0 | 0 | 0 | 0 | 100 | 0 | 0 | 0 | 0 | 0 |
| BRCAN20004180 | 0 | 0 | 0 | 0 | 0 | 0 | 100 | 0 | 0 | 0 | 0 | 0 | 0 |
| BRCAN20005230 | 0 | 0 | 0 | 0 | 0 | 0 | 100 | 0 | 0 | 0 | 0 | 0 | 0 |
| BRCAN20005410 | 0 | 0 | 0 | 0 | 0 | 0 | 100 | 0 | 0 | 0 | 0 | 0 | 0 |
| BRCOC10000400 | 0 | 0 | 0 | 0 | 0 | 0 | 0 | 59.913 | 40.087 | 0 | 0 | 0 | 0 |
| BRCOC20000470 | 0 | 0 | 0 | 0 | 50.495 | 0 | 0 | 0 | 49.505 | 0 | 0 | 0 | 0 |
| BRCOC20003600 | 0 | 0 | 0 | 0 | 0 | 0 | 39.923 | 0 | 35.994 | 24.083 | 0 | 0 | 0 |
| BRHIP10000720 | 0 | 0 | 0 | 0 | 0 | 0 | 0 | 0 | 0 | 100 | 0 | 0 | 0 |
| BRHIP10001040 | 1.184 | 1.608 | 0 | 0 | 6.947 | 7.335 | 12.591 | 13.233 | 13.622 | 10.633 | 7.156 | 4.61 | 0 |
| BRHIP20000210 | 0 | 0 | 0 | 0 | 0 | 0 | 0 | 0 | 0 | 100 | 0 | 0 | 0 |
| BRHIPZ0003590 | 0 | 0 | 0 | 0 | 0 | 0 | 0 | 0 | 0 | 100 | 0 | 0 | 0 |
| BRHIP20005060 | 0 | 0 | 0 | 0 | 0 | 0 | 0 | 0 | 38.356 | 0 | 0 | 0 | 0 |
| BRSSN20001970 | 0 | 0 | 0 | 0 | 0 | 0 | 0 | 0 | 0 | 0 | 100 | 0 | 0 |
| BRSSN20005610 | 23.474 | 15.945 | 0 | 0 | 0 | 14.542 | 0 | 0 | 0 | 0 | 23.646 | 0 | 0 |

TABLE 22-continued

| | | | | | | | | | | | | | |
|---|---|---|---|---|---|---|---|---|---|---|---|---|---|
| BRSSN20005660 | 0 | 34.081 | 0 | 16.116 | 24.533 | 0 | 0 | 0 | 0 | 0 | 25.27 | 0 | 0 |
| BRSSN20066440 | 0 | 0 | 0 | 0 | 0 | 0 | 0 | 0 | 0 | 0 | 100 | 0 | 0 |
| BRSSN20074640 | 0 | 0 | 0 | 0 | 0 | 0 | 0 | 0 | 48.765 | 0 | 51.235 | 0 | 0 |
| BRSSN20091190 | 0 | 0 | 0 | 0 | 0 | 0 | 0 | 0 | 0 | 0 | 68.148 | 0 | 0 |
| BRSSN20092440 | 0 | 0 | 0 | 0 | 0 | 0 | 0 | 0 | 0 | 0 | 34.564 | 0 | 0 |
| BRSSN20093890 | 0 | 0 | 0 | 0 | 0 | 0 | 0 | 0 | 0 | 0 | 100 | 0 | 0 |
| CTONG20032930 | 0 | 32.048 | 0 | 0 | 0 | 0 | 0 | 0 | 0 | 0 | 0 | 0 | 0 |
| CTONG20035240 | 44.214 | 0 | 0 | 0 | 0 | 0 | 0 | 0 | 0 | 0 | 0 | 0 | 0 |
| CTONG20044870 | 0 | 0 | 0 | 0 | 0 | 0 | 0 | 0 | 0 | 25.315 | 0 | 0 | 0 |
| CTONG20063930 | 0 | 0 | 0 | 0 | 0 | 27.859 | 0 | 0 | 0 | 0 | 0 | 43.771 | 0 |
| CTONG20069320 | 0 | 0 | 0 | 5.712 | 0 | 5.509 | 0 | 0 | 0 | 0 | 0 | 0 | 0 |
| CTONG20070720 | 0 | 0 | 0 | 0 | 11.919 | 0 | 0 | 7.568 | 0 | 0 | 12.278 | 0 | 0 |
| CTONG20071040 | 0 | 0 | 0 | 0 | 0 | 0 | 0 | 15.932 | 0 | 0 | 51.694 | 0 | 0 |
| CTONG20071680 | 0 | 0 | 0 | 0 | 0 | 0 | 0 | 0 | 0 | 50.418 | 0 | 0 | 0 |
| CTONG20074170 | 44.214 | 0 | 0 | 0 | 0 | 0 | 0 | 0 | 0 | 0 | 0 | 0 | 0 |
| CTONG20078340 | 0 | 0 | 0 | 0 | 0 | 0 | 0 | 0 | 0 | 25.315 | 0 | 0 | 0 |
| CTONG20079590 | 0 | 0 | 0 | 0 | 14.657 | 0 | 0 | 0 | 0 | 0 | 15.097 | 0 | 0 |

TABLE 23

| | | | | | | | | | | | | | |
|---|---|---|---|---|---|---|---|---|---|---|---|---|---|
| CTONG20080140 | 0 | 0 | 0 | 0 | 0 | 0 | 0 | 0 | 0 | 28.14 | 44.187 | 0 | 0 |
| CTONG20085210 | 44.007 | 0 | 0 | 0 | 0 | 0 | 0 | 0 | 0 | 28.231 | 0 | 0 | 0 |
| CTONG20133720 | 0 | 0 | 0 | 0 | 0 | 5.755 | 0 | 0 | 0 | 5.959 | 0 | 0 | 0 |
| CTONG20165750 | 23.734 | 0 | 18.524 | 0 | 0 | 0 | 0 | 0 | 0 | 0 | 0 | 0 | 0 |
| CTONG20168240 | 18.734 | 0 | 0 | 0 | 0 | 0 | 0 | 0 | 0 | 0 | 0 | 0 | 0 |
| CTONG20170940 | 0 | 0 | 0 | 0 | 0 | 0 | 10.747 | 0 | 0 | 0 | 0 | 0 | 0 |
| CTONG20183430 | 44.214 | 0 | 0 | 0 | 0 | 0 | 0 | 0 | 0 | 0 | 0 | 0 | 0 |
| CTONG20186370 | 31.217 | 0 | 0 | 0 | 0 | 0 | 0 | 0 | 0 | 0 | 0 | 0 | 0 |
| CTONG20188080 | 0 | 0 | 0 | 0 | 0 | 6.701 | 0 | 0 | 10.371 | 13.878 | 0 | 0 | 0 |
| FCBBF10000230 | 100 | 0 | 0 | 0 | 0 | 0 | 0 | 0 | 0 | 0 | 0 | 0 | 0 |
| FCBBF10002200 | 100 | 0 | 0 | 0 | 0 | 0 | 0 | 0 | 0 | 0 | 0 | 0 | 0 |
| FCBBF10004760 | 100 | 0 | 0 | 0 | 0 | 0 | 0 | 0 | 0 | 0 | 0 | 0 | 0 |
| FCBBF20018680 | 100 | 0 | 0 | 0 | 0 | 0 | 0 | 0 | 0 | 0 | 0 | 0 | 0 |
| FCBBF20020440 | 100 | 0 | 0 | 0 | 0 | 0 | 0 | 0 | 0 | 0 | 0 | 0 | 0 |
| FCBBF20021110 | 100 | 0 | 0 | 0 | 0 | 0 | 0 | 0 | 0 | 0 | 0 | 0 | 0 |
| FCBBF20023490 | 3.866 | 10.504 | 0 | 0 | 0 | 0 | 0 | 0 | 7.413 | 4.96 | 7.525 | 0 | |
| FCBBF20028980 | 100 | 0 | 0 | 0 | 0 | 0 | 0 | 0 | 0 | 0 | 0 | 0 | 0 |
| FCBBF20029280 | 43.802 | 0 | 0 | 0 | 0 | 0 | 0 | 0 | 0 | 56.198 | 0 | 0 | 0 |
| FCBBF20032930 | 33.937 | 0 | 0 | 0 | 0 | 0 | 0 | 0 | 0 | 0 | 0 | 66.063 | 0 |
| FCBBF20033360 | 23.246 | 0 | 22.679 | 0 | 0 | 4.8 | 0 | 0 | 7.429 | 4.971 | 0 | 0 | 0 |
| FCBBF20035430 | 100 | 0 | 0 | 0 | 0 | 0 | 0 | 0 | 0 | 0 | 0 | 0 | 0 |
| FCBBF20035490 | 19.559 | 0 | 0 | 0 | 0 | 0 | 0 | 0 | 0 | 0 | 0 | 0 | 0 |
| FCBBF20036360 | 100 | 0 | 0 | 0 | 0 | 0 | 0 | 0 | 0 | 0 | 0 | 0 | 0 |
| FCBBF20038230 | 100 | 0 | 0 | 0 | 0 | 0 | 0 | 0 | 0 | 0 | 0 | 0 | 0 |
| FCBBF20038950 | 100 | 0 | 0 | 0 | 0 | 0 | 0 | 0 | 0 | 0 | 0 | 0 | 0 |
| FCBBF20041380 | 100 | 0 | 0 | 0 | 0 | 0 | 0 | 0 | 0 | 0 | 0 | 0 | 0 |
| FCBBF20043730 | 100 | 0 | 0 | 0 | 0 | 0 | 0 | 0 | 0 | 0 | 0 | 0 | 0 |
| FCBBF20054390 | 100 | 0 | 0 | 0 | 0 | 0 | 0 | 0 | 0 | 0 | 0 | 0 | 0 |
| FCBBF20056580 | 33.254 | 0 | 0 | 0 | 0 | 0 | 0 | 0 | 0 | 0 | 0 | 0 | 0 |
| FCBBF20069660 | 33.765 | 0 | 0 | 0 | 0 | 0 | 0 | 0 | 0 | 0 | 0 | 0 | 0 |
| FCBBF20061310 | 100 | 0 | 0 | 0 | 0 | 0 | 0 | 0 | 0 | 0 | 0 | 0 | 0 |
| FCBBF20066340 | 10.481 | 0 | 0 | 0 | 0 | 0 | 0 | 13.016 | 0 | 0 | 0 | 0 | 0 |
| FCBBF20070800 | 9.281 | 12.609 | 0 | 0 | 0 | 11.5 | 19.741 | 23.052 | 0 | 23.817 | 0 | 0 | 0 |
| FCBBF20070950 | 11.871 | 0 | 0 | 0 | 0 | 0 | 0 | 0 | 0 | 0 | 0 | 0 | 0 |
| FCBBF30000010 | 100 | 0 | 0 | 0 | 0 | 0 | 0 | 0 | 0 | 0 | 0 | 0 | 0 |
| FCBBF30001020 | 100 | 0 | 0 | 0 | 0 | 0 | 0 | 0 | 0 | 0 | 0 | 0 | 0 |
| FCBBF30001100 | 19.4 | 0 | 37.855 | 0 | 0 | 0 | 0 | 0 | 0 | 0 | 0 | 0 | 0 |

TABLE 24

| | | | | | | | | | | | | | |
|---|---|---|---|---|---|---|---|---|---|---|---|---|---|
| FCBBF30001150 | 100 | 0 | 0 | 0 | 0 | 0 | 0 | 0 | 0 | 0 | 0 | 0 | 0 |
| FCBBF30002270 | 20.773 | 0 | 0 | 0 | 0 | 0 | 0 | 0 | 0 | 0 | 0 | 0 | 0 |
| FCBBF30002280 | 100 | 0 | 0 | 0 | 0 | 0 | 0 | 0 | 0 | 0 | 0 | 0 | 0 |
| FCBBF30002330 | 100 | 0 | 0 | 0 | 0 | 0 | 0 | 0 | 0 | 0 | 0 | 0 | 0 |
| FCBBF30003610 | 100 | 0 | 0 | 0 | 0 | 0 | 0 | 0 | 0 | 0 | 0 | 0 | 0 |
| FCBBF30004340 | 8.95 | 0 | 8.731 | 17.248 | 8.752 | 5.544 | 0 | 11.114 | 0 | 11.482 | 9.015 | 0 | 0 |

TABLE 24-continued

| | | | | | | | | | | | | | |
|---|---|---|---|---|---|---|---|---|---|---|---|---|---|
| FCBBF30004730 | 100 | 0 | 0 | 0 | 0 | 0 | 0 | 0 | 0 | 0 | 0 | 0 | 0 |
| FCBBF30005180 | 100 | 0 | 0 | 0 | 0 | 0 | 0 | 0 | 0 | 0 | 0 | 0 | 0 |
| FCBBF30005360 | 20.082 | 0 | 0 | 0 | 0 | 0 | 0 | 0 | 38.509 | 0 | 0 | 0 | 0 |
| FCBBF30005500 | 100 | 0 | 0 | 0 | 0 | 0 | 0 | 0 | 0 | 0 | 0 | 0 | 0 |
| FCBBF30019140 | 100 | 0 | 0 | 0 | 0 | 0 | 0 | 0 | 0 | 0 | 0 | 0 | 0 |
| FCBBF30019180 | 100 | 0 | 0 | 0 | 0 | 0 | 0 | 0 | 0 | 0 | 0 | 0 | 0 |
| FCBBF30019240 | 100 | 0 | 0 | 0 | 0 | 0 | 0 | 0 | 0 | 0 | 0 | 0 | 0 |
| FCBBF30021900 | 100 | 0 | 0 | 0 | 0 | 0 | 0 | 0 | 0 | 0 | 0 | 0 | 0 |
| FCBBF30022680 | 100 | 0 | 0 | 0 | 0 | 0 | 0 | 0 | 0 | 0 | 0 | 0 | 0 |
| FCBBF30026580 | 42.399 | 57.601 | 0 | 0 | 0 | 0 | 0 | 0 | 0 | 0 | 0 | 0 | 0 |
| FCBBF30029250 | 28.042 | 0 | 0 | 0 | 0 | 0 | 0 | 0 | 0 | 71.958 | 0 | 0 | 0 |
| FCBBF30035570 | 100 | 0 | 0 | 0 | 0 | 0 | 0 | 0 | 0 | 0 | 0 | 0 | 0 |
| FCBBF30042610 | 100 | 0 | 0 | 0 | 0 | 0 | 0 | 0 | 0 | 0 | 0 | 0 | 0 |
| FCBBF30048420 | 100 | 0 | 0 | 0 | 0 | 0 | 0 | 0 | 0 | 0 | 0 | 0 | 0 |
| FCBBF30053300 | 3.746 | 2.544 | 0 | 0 | 0 | 0 | 0 | 2.326 | 0 | 0 | 0 | 0 | 0 |
| FCBBF30056980 | 34.251 | 0 | 0 | 0 | 0 | 0 | 0 | 0 | 0 | 0 | 0 | 0 | 0 |
| FCBBF30062490 | 100 | 0 | 0 | 0 | 0 | 0 | 0 | 0 | 0 | 0 | 0 | 0 | 0 |
| FCBBF30063990 | 100 | 0 | 0 | 0 | 0 | 0 | 0 | 0 | 0 | 0 | 0 | 0 | 0 |
| FCBBF30068210 | 100 | 0 | 0 | 0 | 0 | 0 | 0 | 0 | 0 | 0 | 0 | 0 | 0 |
| FCBBF30071500 | 100 | 0 | 0 | 0 | 0 | 0 | 0 | 0 | 0 | 0 | 0 | 0 | 0 |
| FCBBF30072440 | 36.866 | 0 | 0 | 0 | 0 | 0 | 0 | 0 | 0 | 0 | 0 | 0 | 0 |
| FCBBF30072480 | 100 | 0 | 0 | 0 | 0 | 0 | 0 | 0 | 0 | 0 | 0 | 0 | 0 |
| FCBBF30074530 | 100 | 0 | 0 | 0 | 0 | 0 | 0 | 0 | 0 | 0 | 0 | 0 | 0 |
| FCBBF30074620 | 100 | 0 | 0 | 0 | 0 | 0 | 0 | 0 | 0 | 0 | 0 | 0 | 0 |
| FCBBF30075970 | 100 | 0 | 0 | 0 | 0 | 0 | 0 | 0 | 0 | 0 | 0 | 0 | 0 |
| FCBBF30076310 | 100 | 0 | 0 | 0 | 0 | 0 | 0 | 0 | 0 | 0 | 0 | 0 | 0 |
| FCBBF30078600 | 100 | 0 | 0 | 0 | 0 | 0 | 0 | 0 | 0 | 0 | 0 | 0 | 0 |
| FCBBF30079770 | 42.399 | 57.601 | 0 | 0 | 0 | 0 | 0 | 0 | 0 | 0 | 0 | 0 | 0 |
| FCBBF30080730 | 34.275 | 0 | 0 | 0 | 0 | 0 | 0 | 0 | 65.725 | 0 | 0 | 0 | 0 |
| FCBBF30081000 | 20.379 | 0 | 39.764 | 0 | 39.858 | 0 | 0 | 0 | 0 | 0 | 0 | 0 | 0 |
| FCBBF30085560 | 100 | 0 | 0 | 0 | 0 | 0 | 0 | 0 | 0 | 0 | 0 | 0 | 0 |

TABLE 25

| | | | | | | | | | | | | | |
|---|---|---|---|---|---|---|---|---|---|---|---|---|---|
| FCBBF30088700 | 100 | 0 | 0 | 0 | 0 | 0 | 0 | 0 | 0 | 0 | 0 | 0 | 0 |
| FCBBF30089380 | 51.503 | 0 | 0 | 0 | 0 | 0 | 0 | 0 | 0 | 0 | 0 | 0 | 0 |
| FCBBF30091010 | 100 | 0 | 0 | 0 | 0 | 0 | 0 | 0 | 0 | 0 | 0 | 0 | 0 |
| FCBBF30091520 | 100 | 0 | 0 | 0 | 0 | 0 | 0 | 0 | 0 | 0 | 0 | 0 | 0 |
| FCBBF30093170 | 72.234 | 0 | 0 | 0 | 0 | 0 | 0 | 0 | 0 | 0 | 0 | 0 | 0 |
| FCBBF30095410 | 20.765 | 0 | 0 | 0 | 0 | 0 | 0 | 0 | 0 | 0 | 0 | 0 | 0 |
| FCBBF30099490 | 100 | 0 | 0 | 0 | 0 | 0 | 0 | 0 | 0 | 0 | 0 | 0 | 0 |
| FCBBF30100080 | 100 | 0 | 0 | 0 | 0 | 0 | 0 | 0 | 0 | 0 | 0 | 0 | 0 |
| FCBBF30100120 | 30.645 | 11.895 | 25.627 | 0 | 8.563 | 0 | 9.311 | 5.437 | 0 | 0 | 0 | 8.522 | 0 |
| FCBBF30100410 | 56.537 | 0 | 0 | 0 | 0 | 0 | 0 | 0 | 0 | 0 | 0 | 0 | 0 |
| FCBBF30101240 | 100 | 0 | 0 | 0 | 0 | 0 | 0 | 0 | 0 | 0 | 0 | 0 | 0 |
| FCBBF30101300 | 100 | 0 | 0 | 0 | 0 | 0 | 0 | 0 | 0 | 0 | 0 | 0 | 0 |
| FCBBF30105080 | 100 | 0 | 0 | 0 | 0 | 0 | 0 | 0 | 0 | 0 | 0 | 0 | 0 |
| FCBBF30105440 | 100 | 0 | 0 | 0 | 0 | 0 | 0 | 0 | 0 | 0 | 0 | 0 | 0 |
| FCBBF30105860 | 100 | 0 | 0 | 0 | 0 | 0 | 0 | 0 | 0 | 0 | 0 | 0 | 0 |
| FCBBF30106950 | 30.112 | 0 | 0 | 0 | 0 | 0 | 0 | 0 | 0 | 0 | 0 | 0 | 0 |
| FCBBF30107290 | 56.537 | 0 | 0 | 0 | 0 | 0 | 0 | 0 | 0 | 0 | 0 | 0 | 0 |
| FCBBF30107330 | 100 | 0 | 0 | 0 | 0 | 0 | 0 | 0 | 0 | 0 | 0 | 0 | 0 |
| FCBBF30114180 | 100 | 0 | 0 | 0 | 0 | 0 | 0 | 0 | 0 | 0 | 0 | 0 | 0 |
| FCBBF30114850 | 100 | 0 | 0 | 0 | 0 | 0 | 0 | 0 | 0 | 0 | 0 | 0 | 0 |
| FCBBF30115230 | 30.112 | 0 | 0 | 0 | 0 | 0 | 0 | 0 | 0 | 0 | 0 | 0 | 0 |
| FCBBF30115920 | 100 | 0 | 0 | 0 | 0 | 0 | 0 | 0 | 0 | 0 | 0 | 0 | 0 |
| FCBBF30118670 | 100 | 0 | 0 | 0 | 0 | 0 | 0 | 0 | 0 | 0 | 0 | 0 | 0 |
| FCBBF30118890 | 100 | 0 | 0 | 0 | 0 | 0 | 0 | 0 | 0 | 0 | 0 | 0 | 0 |
| FCBBF30125460 | 4.752 | 6.455 | 9.271 | 0 | 0 | 17.662 | 0 | 5.901 | 0 | 12.193 | 0 | 0 | 0 |
| FCBBF30125880 | 100 | 0 | 0 | 0 | 0 | 0 | 0 | 0 | 0 | 0 | 0 | 0 | 0 |
| FCBBF30128420 | 100 | 0 | 0 | 0 | 0 | 0 | 0 | 0 | 0 | 0 | 0 | 0 | 0 |
| FCBBF30129010 | 100 | 0 | 0 | 0 | 0 | 0 | 0 | 0 | 0 | 0 | 0 | 0 | 0 |
| FCBBF30130410 | 100 | 0 | 0 | 0 | 0 | 0 | 0 | 0 | 0 | 0 | 0 | 0 | 0 |
| FCBBF30130580 | 100 | 0 | 0 | 0 | 0 | 0 | 0 | 0 | 0 | 0 | 0 | 0 | 0 |
| FCBBF30132050 | 100 | 0 | 0 | 0 | 0 | 0 | 0 | 0 | 0 | 0 | 0 | 0 | 0 |
| FCBBF30132660 | 100 | 0 | 0 | 0 | 0 | 0 | 0 | 0 | 0 | 0 | 0 | 0 | 0 |
| FCBBF30135890 | 34.566 | 0 | 0 | 0 | 0 | 0 | 0 | 0 | 0 | 0 | 0 | 0 | 0 |
| FCBBF30136230 | 100 | 0 | 0 | 0 | 0 | 0 | 0 | 0 | 0 | 0 | 0 | 0 | 0 |
| FCBBF30138000 | 100 | 0 | 0 | 0 | 0 | 0 | 0 | 0 | 0 | 0 | 0 | 0 | 0 |
| FCBBF30142290 | 100 | 0 | 0 | 0 | 0 | 0 | 0 | 0 | 0 | 0 | 0 | 0 | 0 |
| FCBBF30143550 | 100 | 0 | 0 | 0 | 0 | 0 | 0 | 0 | 0 | 0 | 0 | 0 | 0 |

TABLE 26

| ID | C1 | C2 | C3 | C4 | C5 | C6 | C7 | C8 | C9 | C10 | C11 | C12 | C13 |
|---|---|---|---|---|---|---|---|---|---|---|---|---|---|
| FCBBF30145670 | 100 | 0 | 0 | 0 | 0 | 0 | 0 | 0 | 0 | 0 | 0 | 0 | 0 |
| FCBBF30151190 | 100 | 0 | 0 | 0 | 0 | 0 | 0 | 0 | 0 | 0 | 0 | 0 | 0 |
| FCBBF30153170 | 100 | 0 | 0 | 0 | 0 | 0 | 0 | 0 | 0 | 0 | 0 | 0 | 0 |
| FCBBF30157270 | 56.537 | 0 | 0 | 0 | 0 | 0 | 0 | 0 | 0 | 0 | 0 | 0 | 0 |
| FCBBF30161780 | 100 | 0 | 0 | 0 | 0 | 0 | 0 | 0 | 0 | 0 | 0 | 0 | 0 |
| FCBBF30164510 | 100 | 0 | 0 | 0 | 0 | 0 | 0 | 0 | 0 | 0 | 0 | 0 | 0 |
| FCBBF30166220 | 100 | 0 | 0 | 0 | 0 | 0 | 0 | 0 | 0 | 0 | 0 | 0 | 0 |
| FCBBF30169280 | 16.742 | 0 | 0 | 0 | 0 | 0 | 0 | 0 | 0 | 0 | 0 | 0 | 0 |
| FCBBF30169870 | 43.802 | 0 | 0 | 0 | 0 | 0 | 0 | 0 | 0 | 56.198 | 0 | 0 | 0 |
| FCBBF30170710 | 100 | 0 | 0 | 0 | 0 | 0 | 0 | 0 | 0 | 0 | 0 | 0 | 0 |
| FCBBF30171230 | 100 | 0 | 0 | 0 | 0 | 0 | 0 | 0 | 0 | 0 | 0 | 0 | 0 |
| FCBBF30172330 | 100 | 0 | 0 | 0 | 0 | 0 | 0 | 0 | 0 | 0 | 0 | 0 | 0 |
| FCBBF30173960 | 56.537 | 0 | 0 | 0 | 0 | 0 | 0 | 0 | 0 | 0 | 0 | 0 | 0 |
| FCBBF30175350 | 8.107 | 0 | 0 | 0 | 0 | 0 | 0 | 0 | 0 | 0 | 0 | 0 | 0 |
| FCBBF30177290 | 100 | 0 | 0 | 0 | 0 | 0 | 0 | 0 | 0 | 0 | 0 | 0 | 0 |
| FCBBF30179180 | 43.582 | 0 | 0 | 0 | 0 | 0 | 0 | 0 | 0 | 0 | 0 | 0 | 0 |
| FCBBF30179740 | 100 | 0 | 0 | 0 | 0 | 0 | 0 | 0 | 0 | 0 | 0 | 0 | 0 |
| FCBBF30181730 | 100 | 0 | 0 | 0 | 0 | 0 | 0 | 0 | 0 | 0 | 0 | 0 | 0 |
| FCBBF30194370 | 100 | 0 | 0 | 0 | 0 | 0 | 0 | 0 | 0 | 0 | 0 | 0 | 0 |
| FCBBF30194550 | 100 | 0 | 0 | 0 | 0 | 0 | 0 | 0 | 0 | 0 | 0 | 0 | 0 |
| FCBBF30195690 | 100 | 0 | 0 | 0 | 0 | 0 | 0 | 0 | 0 | 0 | 0 | 0 | 0 |
| FCBBF30195700 | 100 | 0 | 0 | 0 | 0 | 0 | 0 | 0 | 0 | 0 | 0 | 0 | 0 |
| FCBBF30197840 | 100 | 0 | 0 | 0 | 0 | 0 | 0 | 0 | 0 | 0 | 0 | 0 | 0 |
| FCBBF30198670 | 100 | 0 | 0 | 0 | 0 | 0 | 0 | 0 | 0 | 0 | 0 | 0 | 0 |
| FCBBF30201630 | 100 | 0 | 0 | 0 | 0 | 0 | 0 | 0 | 0 | 0 | 0 | 0 | 0 |
| FCBBF30212210 | 100 | 0 | 0 | 0 | 0 | 0 | 0 | 0 | 0 | 0 | 0 | 0 | 0 |
| FCBBF30215240 | 100 | 0 | 0 | 0 | 0 | 0 | 0 | 0 | 0 | 0 | 0 | 0 | 0 |
| FCBBF30220050 | 100 | 0 | 0 | 0 | 0 | 0 | 0 | 0 | 0 | 0 | 0 | 0 | 0 |
| FCBBF30222910 | 100 | 0 | 0 | 0 | 0 | 0 | 0 | 0 | 0 | 0 | 0 | 0 | 0 |
| FCBBF30223110 | 100 | 0 | 0 | 0 | 0 | 0 | 0 | 0 | 0 | 0 | 0 | 0 | 0 |
| FCBBF30223210 | 100 | 0 | 0 | 0 | 0 | 0 | 0 | 0 | 0 | 0 | 0 | 0 | 0 |
| FCBBF30225930 | 21.93 | 0 | 0 | 0 | 0 | 27.172 | 0 | 0 | 0 | 0 | 0 | 0 | 0 |
| FCBBF30228940 | 51.503 | 0 | 0 | 0 | 0 | 0 | 0 | 0 | 0 | 0 | 0 | 0 | 0 |
| FCBBF30230610 | 100 | 0 | 0 | 0 | 0 | 0 | 0 | 0 | 0 | 0 | 0 | 0 | 0 |
| FCBBF30236670 | 0.694 | 2.83 | 0 | 0.892 | 1.358 | 0 | 0 | 2.586 | 0 | 0.891 | 2.797 | 0 | 3.745 |
| FCBBF30250980 | 100 | 0 | 0 | 0 | 0 | 0 | 0 | 0 | 0 | 0 | 0 | 0 | 0 |
| FCBBF30255680 | 100 | 0 | 0 | 0 | 0 | 0 | 0 | 0 | 0 | 0 | 0 | 0 | 0 |

TABLE 27

| ID | C1 | C2 | C3 | C4 | C5 | C6 | C7 | C8 | C9 | C10 | C11 | C12 | C13 |
|---|---|---|---|---|---|---|---|---|---|---|---|---|---|
| FCBBF30257370 | 15.348 | 13.901 | 0 | 0 | 0 | 0 | 0 | 0 | 0 | 0 | 0 | 9.959 | 0 |
| FCBBF30259050 | 43.768 | 0 | 0 | 56.232 | 0 | 0 | 0 | 0 | 0 | 0 | 0 | 0 | 0 |
| FCBBF30260210 | 100 | 0 | 0 | 0 | 0 | 0 | 0 | 0 | 0 | 0 | 0 | 0 | 0 |
| FCBBF30260480 | 100 | 0 | 0 | 0 | 0 | 0 | 0 | 0 | 0 | 0 | 0 | 0 | 0 |
| FCBBF30263080 | 23.584 | 0 | 0 | 0 | 0 | 0 | 0 | 29.288 | 0 | 0 | 0 | 0 | 0 |
| FCBBF30266510 | 56.537 | 0 | 0 | 0 | 0 | 0 | 0 | 0 | 0 | 0 | 0 | 0 | 0 |
| FCBBF30271990 | 100 | 0 | 0 | 0 | 0 | 0 | 0 | 0 | 0 | 0 | 0 | 0 | 0 |
| FCBBF30275590 | 100 | 0 | 0 | 0 | 0 | 0 | 0 | 0 | 0 | 0 | 0 | 0 | 0 |
| FCBBF30282020 | 46.286 | 0 | 0 | 0 | 0 | 0 | 0 | 0 | 0 | 0 | 0 | 0 | 0 |
| FCBBF30285930 | 100 | 0 | 0 | 0 | 0 | 0 | 0 | 0 | 0 | 0 | 0 | 0 | 0 |
| FCBBF30287940 | 100 | 0 | 0 | 0 | 0 | 0 | 0 | 0 | 0 | 0 | 0 | 0 | 0 |
| FCBBF40000610 | 100 | 0 | 0 | 0 | 0 | 0 | 0 | 0 | 0 | 0 | 0 | 0 | 0 |
| FCBBF40001920 | 100 | 0 | 0 | 0 | 0 | 0 | 0 | 0 | 0 | 0 | 0 | 0 | 0 |
| FCBBF40005000 | 16.459 | 0 | 0 | 0 | 0 | 0 | 0 | 0 | 0 | 0 | 0 | 0 | 0 |
| FCBBF50000410 | 10 | 0 | 0 | 0 | 0 | 0 | 0 | 0 | 0 | 0 | 0 | 0 | 0 |
| FCBBF50000610 | 43.582 | 0 | 0 | 0 | 0 | 0 | 0 | 0 | 0 | 0 | 0 | 0 | 0 |
| FCBBF50001650 | 33.921 | 15.361 | 0 | 14.527 | 0 | 14.01 | 0 | 0 | 0 | 0 | 0 | 0 | 0 |
| FCBBF50003530 | 44.606 | 0 | 0 | 0 | 0 | 0 | 0 | 55.394 | 0 | 0 | 0 | 0 | 0 |
| FCBBF50004950 | 100 | 0 | 0 | 0 | 0 | 0 | 0 | 0 | 0 | 0 | 0 | 0 | 0 |
| FEBRA20005040 | 0 | 100 | 0 | 0 | 0 | 0 | 0 | 0 | 0 | 0 | 0 | 0 | 0 |
| FEBRA20007820 | 0 | 100 | 0 | 0 | 0 | 0 | 0 | 0 | 0 | 0 | 0 | 0 | 0 |
| FEBRA20018670 | 27.69 | 18.809 | 0 | 0 | 0 | 0 | 0 | 0 | 26.549 | 0 | 0 | 26.952 | 0 |
| FEBRA20026820 | 0 | 100 | 0 | 0 | 0 | 0 | 0 | 0 | 0 | 0 | 0 | 0 | 0 |
| FEBRA20027070 | 0 | 8.946 | 0 | 0 | 0 | 0 | 0 | 0 | 0 | 0 | 0 | 0 | 0 |
| FEBRA20029620 | 0 | 100 | 0 | 0 | 0 | 0 | 0 | 0 | 0 | 0 | 0 | 0 | 0 |
| FEBRA20031000 | 23.203 | 31.522 | 45.275 | 0 | 0 | 0 | 0 | 0 | 0 | 0 | 0 | 0 | 0 |
| FEBRA20031150 | 0 | 100 | 0 | 0 | 0 | 0 | 0 | 0 | 0 | 0 | 0 | 0 | 0 |
| FEBRA20031280 | 0 | 58.203 | 41.797 | 0 | 0 | 0 | 0 | 0 | 0 | 0 | 0 | 0 | 0 |
| FEBRA20031810 | 0 | 100 | 0 | 0 | 0 | 0 | 0 | 0 | 0 | 0 | 0 | 0 | 0 |
| FEBRA20035200 | 0 | 100 | 0 | 0 | 0 | 0 | 0 | 0 | 0 | 0 | 0 | 0 | 0 |
| FEBRA20035240 | 0 | 100 | 0 | 0 | 0 | 0 | 0 | 0 | 0 | 0 | 0 | 0 | 0 |

TABLE 27-continued

| | | | | | | | | | | | | | |
|---|---|---|---|---|---|---|---|---|---|---|---|---|---|
| FEBRA20038220 | 0 | 22.453 | 0 | 0 | 0 | 0 | 0 | 0 | 0 | 0 | 0 | 0 | 0 |
| FEBRA20038330 | 5.634 | 15.308 | 5.497 | 0 | 0 | 6.981 | 0 | 0 | 5.402 | 0 | 0 | 0 | 15.195 |
| FEBRA20038970 | 0 | 100 | 0 | 0 | 0 | 0 | 0 | 0 | 0 | 0 | 0 | 0 | 0 |
| FEBRA20039070 | 0 | 100 | 0 | 0 | 0 | 0 | 0 | 0 | 0 | 0 | 0 | 0 | 0 |
| FEBRA20039260 | 0 | 2.55 | 0 | 2.411 | 0 | 2.325 | 0 | 0 | 3.599 | 2.408 | 0 | 3.654 | 0 |
| FEBRA20040230 | 0 | 63.862 | 0 | 0 | 0 | 0 | 0 | 0 | 0 | 0 | 0 | 0 | 0 |

TABLE 28

| | | | | | | | | | | | | | |
|---|---|---|---|---|---|---|---|---|---|---|---|---|---|
| FEBRA20040260 | 0 | 56.854 | 0 | 0 | 0 | 0 | 0 | 0 | 0 | 0 | 0 | 0 | 0 |
| FEBRA20040290 | 2.043 | 2.776 | 0 | 0 | 7.992 | 2.531 | 0 | 5.074 | 0 | 0 | 0 | 0 | 11.021 |
| FEBRA20040560 | 0 | 59.062 | 0 | 0 | 0 | 0 | 0 | 0 | 0 | 0 | 0 | 0 | 0 |
| FEBRA20045380 | 0 | 100 | 0 | 0 | 0 | 0 | 0 | 0 | 0 | 0 | 0 | 0 | 0 |
| FEBRA20046200 | 0 | 17.561 | 0 | 0 | 0 | 0 | 0 | 0 | 0 | 0 | 0 | 0 | 0 |
| FEBRA20046280 | 0 | 100 | 0 | 0 | 0 | 0 | 0 | 0 | 0 | 0 | 0 | 0 | 0 |
| FEBRA20046510 | 0 | 100 | 0 | 0 | 0 | 0 | 0 | 0 | 0 | 0 | 0 | 0 | 0 |
| FEBRA20057010 | 0 | 100 | 0 | 0 | 0 | 0 | 0 | 0 | 0 | 0 | 0 | 0 | 0 |
| FEBRA20063720 | 0 | 34.914 | 12.537 | 0 | 0 | 0 | 0 | 0 | 0 | 0 | 0 | 0 | 0 |
| FEBRA20076200 | 0 | 100 | 0 | 0 | 0 | 0 | 0 | 0 | 0 | 0 | 0 | 0 | 0 |
| FEBRA20078180 | 0 | 20.719 | 0 | 0 | 0 | 0 | 0 | 0 | 0 | 0 | 0 | 0 | 0 |
| FEBRA20078800 | 0 | 22.544 | 0 | 0 | 0 | 0 | 0 | 0 | 0 | 0 | 0 | 0 | 0 |
| FEBRA20080860 | 0 | 100 | 0 | 0 | 0 | 0 | 0 | 0 | 0 | 0 | 0 | 0 | 0 |
| FEBRA20082660 | 0 | 22.641 | 0 | 0 | 0 | 0 | 0 | 0 | 0 | 0 | 0 | 0 | 0 |
| FEBRA20083410 | 0 | 14.361 | 0 | 0 | 0 | 0 | 0 | 0 | 0 | 0 | 0 | 0 | 0 |
| FEBRA20084750 | 0 | 100 | 0 | 0 | 0 | 0 | 0 | 0 | 0 | 0 | 0 | 0 | 0 |
| FEBRA20086600 | 0 | 100 | 0 | 0 | 0 | 0 | 0 | 0 | 0 | 0 | 0 | 0 | 0 |
| FEBRA20087550 | 0 | 6.921 | 0 | 0 | 0 | 0 | 0 | 0 | 9.769 | 0 | 0 | 0 | 0 |
| FEBRA20088610 | 24.122 | 32.771 | 15.689 | 0 | 0 | 0 | 17.101 | 0 | 0 | 10.316 | 0 | 0 | 0 |
| FEBRA20088810 | 0 | 100 | 0 | 0 | 0 | 0 | 0 | 0 | 0 | 0 | 0 | 0 | 0 |
| FEBRA20090160 | 0 | 100 | 0 | 0 | 0 | 0 | 0 | 0 | 0 | 0 | 0 | 0 | 0 |
| FEBRA20090220 | 0 | 6.554 | 2.353 | 0 | 2.359 | 0 | 2.565 | 0 | 6.938 | 0 | 2.43 | 0 | 0 |
| FEBRA20091620 | 0 | 100 | 0 | 0 | 0 | 0 | 0 | 0 | 0 | 0 | 0 | 0 | 0 |
| FEBRA20092760 | 0 | 100 | 0 | 0 | 0 | 0 | 0 | 0 | 0 | 0 | 0 | 0 | 0 |
| FEBRA20093270 | 0 | 100 | 0 | 0 | 0 | 0 | 0 | 0 | 0 | 0 | 0 | 0 | 0 |
| FEBRA20093280 | 0 | 100 | 0 | 0 | 0 | 0 | 0 | 0 | 0 | 0 | 0 | 0 | 0 |
| FE8RA20095410 | 0 | 59.062 | 0 | 0 | 0 | 0 | 0 | 0 | 0 | 0 | 0 | 0 | 0 |
| FEBRA20098040 | 13.01 | 35.349 | 0 | 0 | 0 | 0 | 0 | 0 | 24.947 | 16.692 | 0 | 0 | 0 |
| FEBRA20099860 | 0 | 34.616 | 0 | 0 | 0 | 0 | 0 | 0 | 0 | 65.384 | 0 | 0 | 0 |
| FEBRA20101410 | 0 | 100 | 0 | 0 | 0 | 0 | 0 | 0 | 0 | 0 | 0 | 0 | 0 |
| FEBRA20108020 | 0 | 100 | 0 | 0 | 0 | 0 | 0 | 0 | 0 | 0 | 0 | 0 | 0 |
| FEBRA20108580 | 8.812 | 35.914 | 0 | 0 | 0 | 0 | 0 | 0 | 0 | 0 | 0 | 0 | 0 |
| FEBRA20115930 | 0 | 100 | 0 | 0 | 0 | 0 | 0 | 0 | 0 | 0 | 0 | 0 | 0 |
| FEBRA20116650 | 18.022 | 24.484 | 35.165 | 0 | 0 | 22.329 | 0 | 0 | 0 | 0 | 0 | 0 | 0 |
| FEBRA20121200 | 0 | 36.922 | 0 | 0 | 0 | 0 | 0 | 0 | 0 | 0 | 0 | 0 | 0 |
| FEBRA20121950 | 0 | 100 | 0 | 0 | 0 | 0 | 0 | 0 | 0 | 0 | 0 | 0 | 0 |
| FEBRA20141980 | 0 | 100 | 0 | 0 | 0 | 0 | 0 | 0 | 0 | 0 | 0 | 0 | 0 |

TABLE 29

| | | | | | | | | | | | | | |
|---|---|---|---|---|---|---|---|---|---|---|---|---|---|
| FEBRA20150420 | 0 | 34.905 | 0 | 0 | 0 | 31.834 | 0 | 0 | 0 | 0 | 0 | 0 | 0 |
| FEBRA20151750 | 0 | 100 | 0 | 0 | 0 | 0 | 0 | 0 | 0 | 0 | 0 | 0 | 0 |
| FEBRA20163980 | 9.44 | 12.825 | 0 | 0 | 0 | 0 | 0 | 0 | 0 | 0 | 0 | 0 | 0 |
| FEBRA20170240 | 0 | 36.922 | 0 | 0 | 0 | 0 | 0 | 0 | 0 | 0 | 0 | 0 | 0 |
| FEBRA20112230 | 0 | 100 | 0 | 0 | 0 | 0 | 0 | 0 | 0 | 0 | 0 | 0 | 0 |
| FEBRA20173330 | 0 | 100 | 0 | 0 | 0 | 0 | 0 | 0 | 0 | 0 | 0 | 0 | 0 |
| FEBRA20175020 | 0 | 100 | 0 | 0 | 0 | 0 | 0 | 0 | 0 | 0 | 0 | 0 | 0 |
| FEBRA20175330 | 0 | 100 | 0 | 0 | 0 | 0 | 0 | 0 | 0 | 0 | 0 | 0 | 0 |
| FEBRA20177800 | 0 | 100 | 0 | 0 | 0 | 0 | 0 | 0 | 0 | 0 | 0 | 0 | 0 |
| FEBRA20180510 | 0 | 100 | 0 | 0 | 0 | 0 | 0 | 0 | 0 | 0 | 0 | 0 | 0 |
| FEBRA20182030 | 42.399 | 57.601 | 0 | 0 | 0 | 0 | 0 | 0 | 0 | 0 | 0 | 0 | 0 |
| FEBRA20187460 | 0 | 100 | 0 | 0 | 0 | 0 | 0 | 0 | 0 | 0 | 0 | 0 | 0 |
| FEBRA20191720 | 0 | 100 | 0 | 0 | 0 | 0 | 0 | 0 | 0 | 0 | 0 | 0 | 0 |
| HCHON20002650 | 0 | 0 | 0 | 19.66 | 0 | 0 | 0 | 0 | 0 | 0 | 0 | 0 | 0 |
| HCHON20002710 | 13.027 | 17.697 | 0 | 0 | 0 | 0 | 0 | 0 | 0 | 0 | 0 | 0 | 0 |
| HEART10001490 | 3.58 | 0 | 6.986 | 0 | 0 | 0 | 0 | 0 | 0 | 0 | 0 | 0 | 0 |
| HLUNG20008460 | 0 | 0 | 32.46 | 0 | 0 | 0 | 0 | 0 | 0 | 0 | 0 | 0 | 0 |

TABLE 29-continued

| | | | | | | | | | | | | | |
|---|---|---|---|---|---|---|---|---|---|---|---|---|---|
| HLUNG20011460 | 0 | 0 | 0 | 0 | 0 | 0 | 0 | 23.423 | 0 | 0 | 0 | 0 | 0 |
| HLUNG20014590 | 0 | 0 | 0 | 0 | 0 | 0 | 0 | 11.025 | 0 | 0 | 0 | 0 | 0 |
| HLUNG20015070 | 0 | 0 | 0 | 0 | 0 | 5.433 | 0 | 0 | 8.409 | 0 | 0 | 0 | 0 |
| HLUNG20015180 | 0 | 3.161 | 0 | 0 | 0 | 0 | 0 | 0 | 0 | 0 | 4.688 | 0 | 0 |
| HLUNG20020850 | 0 | 0 | 0 | 0 | 32.512 | 0 | 0 | 0 | 0 | 0 | 0 | 0 | 0 |
| HLUNG20028110 | 0 | 0 | 0 | 0 | 0 | 23.382 | 0 | 0 | 0 | 0 | 0 | 0 | 0 |
| HLUNG20031620 | 19.763 | 0 | 0 | 0 | 0 | 0 | 0 | 0 | 0 | 0 | 0 | 0 | 0 |
| HLUNG20032460 | 0 | 0 | 0 | 0 | 21.215 | 0 | 0 | 13.47 | 0 | 0 | 0 | 0 | 0 |
| HLUNG20033060 | 0 | 0 | 17.556 | 0 | 0 | 0 | 0 | 0 | 0 | 11.544 | 0 | 0 | 0 |
| HLUNG20041590 | 2.514 | 3.415 | 0 | 0 | 0 | 3.115 | 0 | 3.122 | 0 | 0 | 0 | 0 | 0 |
| HLUNG20045340 | 0 | 0 | 0 | 0 | 0 | 0 | 0 | 0 | 0 | 2.424 | 0 | 0 | 0 |
| HLUNG20056560 | 0 | 0 | 0 | 24.039 | 0 | 0 | 0 | 0 | 0 | 0 | 0 | 0 | 0 |
| HLUNG20068120 | 6.274 | 0 | 0 | 0 | 0 | 0 | 0 | 0 | 0 | 0 | 0 | 0 | 0 |
| HLUNG20081390 | 0 | 0 | 0 | 0 | 0 | 0 | 0 | 0 | 0 | 20.993 | 0 | 0 | 0 |
| HLUNG20083480 | 3.232 | 0 | 12.614 | 4.153 | 0 | 4.005 | 0 | 0 | 6.198 | 4.147 | 0 | 0 | 0 |
| HLUNG20085210 | 0 | 0 | 0 | 0 | 0 | 0 | 0 | 0 | 0 | 0 | 0 | 24.45 | 0 |
| HLUNG20094130 | 0 | 0 | 0 | 0 | 0 | 0 | 0 | 0 | 0 | 24.013 | 0 | 0 | 0 |
| KIDNE20080690 | 0 | 0 | 0 | 7.981 | 24.298 | 11.545 | 0 | 3.857 | 17.867 | 3.985 | 12.514 | 12.092 | 0 |
| KIDNE20084030 | 0 | 0 | 0 | 0 | 0 | 26.283 | 0 | 0 | 0 | 13.608 | 0 | 0 | 0 |
| KIDNE20086660 | 0 | 0 | 0 | 0 | 0 | 0 | 52.987 | 0 | 0 | 0 | 0 | 0 | 0 |

TABLE 30

| | | | | | | | | | | | | | |
|---|---|---|---|---|---|---|---|---|---|---|---|---|---|
| KIDNE20094670 | 0 | 0 | 0 | 40.506 | 0 | 0 | 0 | 0 | 0 | 0 | 0 | 0 | 0 |
| KIDNE20134130 | 34.637 | 0 | 0 | 0 | 0 | 0 | 0 | 0 | 0 | 0 | 0 | 0 | 0 |
| KIDNE20138450 | 20.652 | 0 | 0 | 0 | 0 | 0 | 0 | 0 | 0 | 0 | 0 | 0 | 0 |
| KIDNE20140870 | 12.151 | 0 | 0 | 0 | 0 | 0 | 0 | 0 | 23.3 | 0 | 0 | 0 | 0 |
| KIDNE20149780 | 0 | 0 | 0 | 0 | 0 | 39.635 | 0 | 0 | 0 | 0 | 0 | 0 | 0 |
| KIDNE20170400 | 0 | 0 | 0 | 0 | 0 | 0 | 0 | 0 | 0 | 13.296 | 0 | 0 | 0 |
| KIDNE20173430 | 0 | 0 | 0 | 0 | 0 | 0 | 0 | 0 | 0 | 0 | 0 | 0 | 26.207 |
| MESAN20021860 | 0 | 5.216 | 0 | 0 | 0 | 0 | 0 | 0 | 0 | 0 | 0 | 7.474 | 0 |
| MESAN20030350 | 19.943 | 0 | 0 | 0 | 0 | 0 | 0 | 0 | 0 | 0 | 0 | 0 | 0 |
| MESAN20034440 | 0 | 0 | 0 | 0 | 0 | 0 | 0 | 0 | 0 | 0 | 0 | 19.81 | 0 |
| MESAN20038520 | 4.894 | 0 | 0 | 0 | 0 | 12.127 | 0 | 0 | 0 | 0 | 0 | 0 | 0 |
| MESAN20045750 | 0 | 0 | 0 | 0 | 0 | 0 | 0 | 0 | 48.859 | 0 | 0 | 0 | 0 |
| MESAN20067430 | 0 | 0 | 0 | 0 | 0 | 0 | 0 | 0 | 0 | 0 | 0 | 0 | 26.308 |
| MESAN20089260 | 24.608 | 0 | 0 | 0 | 0 | 0 | 0 | 0 | 0 | 0 | 0 | 0 | 0 |
| MESAN20095800 | 0 | 0 | 0 | 0 | 0 | 0 | 0 | 8.529 | 0 | 8.812 | 13.837 | 0 | 0 |
| NT2NE20026200 | 0 | 0 | 0 | 0 | 1.221 | 1.547 | 1.328 | 0.775 | 1.197 | 0 | 0 | 3.646 | 0 |
| NT2NE20033150 | 0 | 0 | 49.867 | 0 | 0 | 0 | 0 | 0 | 0 | 0 | 0 | 0 | 0 |
| NT2NE20042550 | 0 | 40.917 | 0 | 0 | 0 | 0 | 0 | 0 | 0 | 0 | 0 | 0 | 0 |
| NT2NE20045190 | 7.802 | 0 | 7.612 | 0 | 0 | 4.834 | 0 | 0 | 0 | 0 | 7.86 | 0 | 21.043 |
| NT2NE20053950 | 21.964 | 0 | 21.429 | 14.11 | 0 | 0 | 0 | 0 | 0 | 0 | 0 | 0 | 0 |
| NT2NE20061030 | 20.536 | 0 | 0 | 0 | 0 | 0 | 0 | 0 | 0 | 0 | 0 | 0 | 0 |
| NT2NE20069580 | 0 | 40.917 | 0 | 0 | 0 | 0 | 0 | 0 | 0 | 0 | 0 | 0 | 0 |
| NT2NE20082130 | 0 | 0 | 0 | 0 | 0 | 0 | 0 | 24.112 | 0 | 0 | 0 | 37.798 | 0 |
| NT2NE20082600 | 33.765 | 0 | 0 | 0 | 0 | 0 | 0 | 0 | 0 | 0 | 0 | 0 | 0 |
| NT2NE20088030 | 0 | 0 | 0 | 39.575 | 0 | 0 | 0 | 0 | 0 | 0 | 0 | 0 | 0 |
| NT2NE20092950 | 0 | 14.453 | 0 | 0 | 0 | 0 | 0 | 0 | 0 | 13.65 | 0 | 20.71 | 0 |
| NT2NE20095230 | 0 | 0 | 0 | 0 | 0 | 17.429 | 0 | 0 | 0 | 0 | 0 | 27.383 | 0 |
| NT2NE20108420 | 23.147 | 31.446 | 0 | 0 | 0 | 0 | 0 | 0 | 0 | 0 | 0 | 0 | 0 |
| NT2NE20111190 | 0 | 0 | 0 | 0 | 0 | 38.711 | 0 | 0 | 0 | 0 | 0 | 0 | 0 |
| NT2NE20112210 | 0 | 0 | 0 | 0 | 0 | 0 | 0 | 0 | 0 | 0 | 0 | 0 | 73.331 |
| NT2NE20141040 | 0 | 24.941 | 0 | 0 | 0 | 0 | 39.046 | 0 | 0 | 0 | 0 | 0 | 0 |
| NT2NE20177210 | 0 | 0 | 0 | 28.643 | 0 | 27.623 | 0 | 0 | 0 | 0 | 0 | 0 | 0 |
| NT2NE20181800 | 23.559 | 0 | 0 | 0 | 0 | 0 | 0 | 0 | 0 | 30.226 | 0 | 0 | 0 |
| NT2RI20021200 | 0 | 0 | 0 | 0 | 0 | 4.233 | 7.265 | 8.484 | 6.55 | 35.063 | 6.882 | 6.65 | 0 |
| NT2RP70001120 | 0 | 0 | 33.312 | 0 | 0 | 0 | 0 | 0 | 0 | 0 | 0 | 0 | 0 |
| NT2RP70001730 | 22.691 | 8.808 | 31.625 | 0 | 0 | 0 | 0 | 0 | 3.108 | 0 | 3.265 | 0 | 0 |
| NT2RP70012830 | 0 | 0 | 11.535 | 0 | 0 | 0 | 0 | 0 | 5.668 | 0 | 0 | 11.508 | 0 |

TABLE 31

| | | | | | | | | | | | | | |
|---|---|---|---|---|---|---|---|---|---|---|---|---|---|
| NT2RP70035110 | 12.287 | 0 | 0 | 0 | 0 | 0 | 0 | 0 | 0 | 0 | 0 | 0 | 0 |
| NT2RP70057500 | 7.128 | 0 | 13.909 | 0 | 0 | 0 | 0 | 0 | 0 | 0 | 0 | 0 | 0 |
| NT2RP70075300 | 3.525 | 0 | 3.439 | 2.264 | 0 | 2.184 | 0 | 0 | 0 | 0 | 0 | 0 | 0 |

TABLE 31-continued

| | | | | | | | | | | | | | |
|---|---|---|---|---|---|---|---|---|---|---|---|---|---|
| NT2RP70087140 | 3.902 | 10.602 | 0 | 10.026 | 0 | 24.172 | 0 | 0 | 0 | 0 | 0 | 0 | 21.047 |
| NT2RP70090870 | 17.949 | 0 | 17.511 | 0 | 0 | 0 | 0 | 0 | 0 | 0 | 0 | 0 | 0 |
| NTONG20002230 | 0 | 0 | 24.855 | 0 | 0 | 0 | 0 | 0 | 0 | 0 | 0 | 0 | 0 |
| NTONG20017620 | 22.333 | 0 | 14.526 | 0 | 0 | 18.447 | 0 | 0 | 0 | 0 | 14.998 | 0 | 0 |
| NTONG20049180 | 15.998 | 0 | 0 | 0 | 0 | 0 | 0 | 0 | 0 | 0 | 0 | 0 | 0 |
| NTONG20055200 | 0 | 0 | 0 | 0 | 0 | 0 | 0 | 3.357 | 10.367 | 10.405 | 0 | 0 | 14.581 |
| OCBBF20000740 | 30.257 | 10.276 | 44.279 | 0 | 0 | 9.372 | 0 | 0 | 0 | 0 | 0 | 0 | 0 |
| OCBBF20001780 | 0 | 0 | 23.138 | 15.235 | 23.193 | 0 | 0 | 0 | 0 | 0 | 0 | 23.084 | 0 |
| OCBBF20005220 | 0 | 0 | 67.45 | 0 | 0 | 0 | 0 | 0 | 0 | 0 | 0 | 0 | 0 |
| OCBBF20009820 | 0 | 0 | 10.495 | 0 | 0 | 0 | 0 | 0 | 5.157 | 0 | 0 | 0 | 0 |
| OCBBF20011860 | 0 | 0 | 100 | 0 | 0 | 0 | 0 | 0 | 0 | 0 | 0 | 0 | 0 |
| OCBBF20012520 | 0 | 0 | 100 | 0 | 0 | 0 | 0 | 0 | 0 | 0 | 0 | 0 | 0 |
| OCBBF20016390 | 10.001 | 13.586 | 19.514 | 0 | 0 | 0 | 21.27 | 12.419 | 0 | 0 | 0 | 0 | 0 |
| OCBBF20016810 | 0 | 0 | 100 | 0 | 0 | 0 | 0 | 0 | 0 | 0 | 0 | 0 | 0 |
| OCBBF20109450 | 0 | 0 | 100 | 0 | 0 | 0 | 0 | 0 | 0 | 0 | 0 | 0 | 0 |
| OCBBF20109780 | 0 | 0 | 100 | 0 | 0 | 0 | 0 | 0 | 0 | 0 | 0 | 0 | 0 |
| OCBBF20110210 | 23.865 | 0 | 46.566 | 0 | 0 | 29.569 | 0 | 0 | 0 | 0 | 0 | 0 | 0 |
| OCBBF20110730 | 0 | 35.856 | 34.333 | 0 | 0 | 0 | 18.711 | 0 | 0 | 0 | 0 | 0 | 0 |
| OCBBF20111370 | 0 | 0 | 100 | 0 | 0 | 0 | 0 | 0 | 0 | 0 | 0 | 0 | 0 |
| OCBBF20111600 | 0 | 0 | 100 | 0 | 0 | 0 | 0 | 0 | 0 | 0 | 0 | 0 | 0 |
| OCBBF20112280 | 0 | 0 | 100 | 0 | 0 | 0 | 0 | 0 | 0 | 0 | 0 | 0 | 0 |
| OCBBF20112320 | 0 | 0 | 100 | 0 | 0 | 0 | 0 | 0 | 0 | 0 | 0 | 0 | 0 |
| OCBBF20113110 | 0 | 0 | 100 | 0 | 0 | 0 | 0 | 0 | 0 | 0 | 0 | 0 | 0 |
| OCBBF20115360 | 7.945 | 10.793 | 31.004 | 10.207 | 0 | 9.843 | 0 | 9.866 | 0 | 0 | 0 | 0 | 0 |
| OCBBF20116250 | 0 | 41.046 | 58.954 | 0 | 0 | 0 | 0 | 0 | 0 | 0 | 0 | 0 | 0 |
| OCBBF20117220 | 15.972 | 21.698 | 62.33 | 0 | 0 | 0 | 0 | 0 | 0 | 0 | 0 | 0 | 0 |
| OCBBF20118720 | 0 | 0 | 100 | 0 | 0 | 0 | 0 | 0 | 0 | 0 | 0 | 0 | 0 |
| OCBBF20119810 | 0 | 0 | 100 | 0 | 0 | 0 | 0 | 0 | 0 | 0 | 0 | 0 | 0 |
| OCBBF20120010 | 0 | 0 | 100 | 0 | 0 | 0 | 0 | 0 | 0 | 0 | 0 | 0 | 0 |
| OCBBF20120950 | 0 | 0 | 100 | 0 | 0 | 0 | 0 | 0 | 0 | 0 | 0 | 0 | 0 |
| OCBBF20121910 | 0 | 0 | 100 | 0 | 0 | 0 | 0 | 0 | 0 | 0 | 0 | 0 | 0 |
| OCBBF20123200 | 0 | 0 | 100 | 0 | 0 | 0 | 0 | 0 | 0 | 0 | 0 | 0 | 0 |
| OCBBF20142290 | 0 | 5.048 | 21.749 | 0 | 0 | 4.603 | 0 | 0 | 0 | 14.301 | 0 | 0 | 20.041 |
| OCBBF20147070 | 0 | 0 | 100 | 0 | 0 | 0 | 0 | 0 | 0 | 0 | 0 | 0 | 0 |

TABLE 32

| | | | | | | | | | | | | | |
|---|---|---|---|---|---|---|---|---|---|---|---|---|---|
| OCBBF20152330 | 0 | 0 | 100 | 0 | 0 | 0 | 0 | 0 | 0 | 0 | 0 | 0 | 0 |
| OCBBF20155030 | 0 | 0 | 50.561 | 0 | 0 | 0 | 0 | 0 | 0 | 0 | 0 | 0 | 0 |
| OCBBF20156450 | 0 | 0 | 100 | 0 | 0 | 0 | 0 | 0 | 0 | 0 | 0 | 0 | 0 |
| OCBBF20157970 | 0 | 0 | 71.737 | 0 | 0 | 400 | 0 | 0 | 0 | 0 | 0 | 0 | 0 |
| OCBBF20160380 | 0 | 0 | 100 | 0 | 0 | 0 | 0 | 0 | 0 | 0 | 0 | 0 | 0 |
| OCBBF20165900 | 0 | 0 | 100 | 0 | 0 | 0 | 0 | 0 | 0 | 0 | 0 | 0 | 0 |
| OCBBF20165910 | 0 | 0 | 100 | 0 | 0 | 0 | 0 | 0 | 0 | 0 | 0 | 0 | 0 |
| OCBBF20166890 | 0 | 0 | 33.861 | 0 | 0 | 0 | 0 | 0 | 0 | 0 | 0 | 0 | 0 |
| OCBBF20166900 | 0 | 0 | 100 | 0 | 0 | 0 | 0 | 0 | 0 | 0 | 0 | 0 | 0 |
| OCBBF20167290 | 0 | 0 | 19.457 | 0 | 0 | 37.065 | 0 | 0 | 0 | 0 | 0 | 0 | 0 |
| OCBBF20170350 | 7.839 | 10.65 | 30.593 | 0 | 15.332 | 0 | 0 | 9.735 | 0 | 10.058 | 15.793 | 0 | 0 |
| OCBBF20114580 | 25.726 | 0 | 25.099 | 0 | 0 | 0 | 0 | 0 | 0 | 0 | 0 | 0 | 0 |
| OCBBF20174890 | 0 | 0 | 33.338 | 0 | 0 | 0 | 0 | 0 | 0 | 0 | 34.421 | 0 | 0 |
| OCBBF20175360 | 10.644 | 0 | 20.77 | 0 | 0 | 0 | 0 | 0 | 0 | 0 | 0 | 0 | 0 |
| OCBBF20176650 | 0 | 0 | 100 | 0 | 0 | 0 | 0 | 0 | 0 | 0 | 0 | 0 | 0 |
| OCBBF20177540 | 13.37 | 18.164 | 26.088 | 0 | 0 | 50 | 0 | 0 | 0 | 0 | 0 | 0 | 0 |
| OCBBF20177910 | 18.157 | 0 | 35.429 | 0 | 0 | 0 | 0 | 0 | 0 | 0 | 0 | 0 | 0 |
| OCBBF20182060 | 0 | 0 | 100 | 0 | 0 | 0 | 0 | 0 | 0 | 0 | 0 | 0 | 0 |
| OCBBF20185630 | 0 | 0 | 71.737 | 0 | 0 | 0 | 0 | 0 | 0 | 0 | 0 | 0 | 0 |
| OCBBF20188280 | 0 | 0 | 100 | 0 | 0 | 0 | 0 | 0 | 0 | 0 | 0 | 0 | 0 |
| OCBBF20191950 | 0 | 0 | 100 | 0 | 0 | 0 | 0 | 0 | 0 | 0 | 0 | 0 | 0 |
| PLACE60054820 | 0 | 0 | 0 | 0 | 0 | 0 | 0 | 19.271 | 0 | 0 | 31.264 | 0 | 0 |
| PLACE60056910 | 0 | 0 | 0 | 0 | 0 | 39.559 | 0 | 0 | 0 | 0 | 0 | 0 | 0 |
| PLACE60061370 | 0 | 0 | 0 | 0 | 18.524 | 11.735 | 0 | 11.761 | 0 | 0 | 0 | 0 | 0 |
| PLACE60064740 | 0 | 0 | 0 | 0 | 0 | 39.559 | 0 | 0 | 0 | 0 | 0 | 0 | 0 |
| PLACE60073090 | 0 | 0 | 0 | 7.15 | 0 | 0 | 0 | 0 | 0 | 0 | 0 | 0 | 0 |
| PLACE60120280 | 0 | 0 | 0 | 0 | 0 | 15.655 | 0 | 0 | 0 | 0 | 0 | 0 | 0 |
| PLACE60132200 | 0 | 0 | 0 | 0 | 0 | 0 | 0 | 0 | 22.765 | 0 | 0 | 0 | 0 |
| PLACE60150510 | 33.854 | 0 | 0 | 0 | 0 | 0 | 0 | 0 | 0 | 0 | 34.102 | 0 | 0 |
| PLACE60154450 | 0 | 0 | 0 | 0 | 33.747 | 0 | 0 | 0 | 0 | 0 | 0 | 33.589 | 0 |
| PLACE60157310 | 0 | 0 | 0 | 0 | 0 | 0 | 0 | 0 | 66.952 | 0 | 0 | 0 | 0 |
| PLACE60162100 | 0 | 26.059 | 0 | 0 | 0 | 0 | 0 | 0 | 0 | 0 | 0 | 0 | 0 |
| PROST10002150 | 10.939 | 0 | 0 | 14.054 | 0 | 650 | 0 | 0 | 0 | 0 | 0 | 0 | 0 |
| PROST20014150 | 0 | 0 | 67.029 | 0 | 0 | 0 | 0 | 0 | 0 | 0 | 0 | 0 | 0 |

TABLE 32-continued

| | | | | | | | | | | | | | |
|---|---|---|---|---|---|---|---|---|---|---|---|---|---|
| PROST20016760 | 2.116 | 2.874 | 0 | 5.436 | 0 | 5.243 | 4.5 | 0 | 0 | 2.714 | 0 | 4.118 | 0 |
| PROST20024250 | 0 | 0 | 32.244 | 0 | 0 | 20.475 | 0 | 0 | 0 | 0 | 0 | 0 | 0 |
| PROST20035170 | 0 | 0 | 11.544 | 0 | 0 | 0 | 0 | 0 | 0 | 0 | 0 | 0 | 0 |

TABLE 33

| | | | | | | | | | | | | |
|---|---|---|---|---|---|---|---|---|---|---|---|---|
| PROST20035830 | 34.251 | 0 | 0 | 0 | 0 | 0 | 0 | 0 | 0 | 0 | 0 | 0 |
| PROST20042700 | 13.112 | 0 | 0 | 0 | 0 | 0 | 0 | 16.283 | 0 | 0 | 0 | 0 |
| PROST20045700 | 11.365 | 0 | 0 | 0 | 22.229 | 0 | 0 | 0 | 0 | 0 | 0 | 0 |
| PROST20050390 | 23.916 | 0 | 0 | 0 | 0 | 0 | 0 | 0 | 0 | 0 | 0 | 0 |
| PROST20054660 | 0 | 0 | 0 | 40.095 | 0 | 0 | 0 | 0 | 0 | 0 | 0 | 0 |
| PROST20078710 | 0 | 0 | 33.455 | 0 | 0 | 0 | 0 | 0 | 0 | 0 | 0 | 0 |
| PROST20094000 | 0 | 0 | 27.644 | 0 | 0 | 0 | 0 | 0 | 0 | 0 | 0 | 0 |
| PROST20097310 | 0 | 0 | 0 | 0 | 0 | 0 | 39.181 | 0 | 0 | 0 | 0 | 0 |
| PROST20097840 | 0 | 16.947 | 0 | 0 | 0 | 0 | 0 | 0 | 23.921 | 16.005 | 0 | 0 |
| PROST20103820 | 0 | 0 | 0 | 0 | 0 | 39.227 | 0 | 0 | 0 | 0 | 0 | 0 |
| PROST20114100 | 0 | 0 | 0 | 0 | 0 | 39.227 | 0 | 0 | 0 | 0 | 0 | 0 |
| PROST20130320 | 0 | 12.898 | 0 | 12.198 | 0 | 0 | 0 | 0 | 0 | 12.181 | 0 | 0 |
| PROST20151370 | 0 | 0 | 0 | 0 | 0 | 39.227 | 0 | 0 | 0 | 0 | 0 | 0 |
| PUAEN10000650 | 0 | 0 | 0 | 4.545 | 3.46 | 0 | 3.762 | 8.786 | 3.392 | 0 | 3.564 | 0 | 0 |
| PUAEN10001640 | 0 | 3.714 | 0 | 0 | 0 | 0 | 0 | 0 | 0 | 3.508 | 0 | 0 | 0 |
| PUAEN20003120 | 15.692 | 0 | 0 | 0 | 0 | 0 | 0 | 0 | 0 | 0 | 0 | 0 |
| SKNMC20006350 | 0 | 0 | 0 | 0 | 0 | 0 | 0 | 0.653 | 0 | 0 | 0 | 0 | 2.835 |
| SKNSH10001010 | 0 | 0 | 8.649 | 5.695 | 8.669 | 5.492 | 9.427 | 5.504 | 0 | 11.373 | 8.93 | 0 | 0 |
| SKNSH20007160 | 15.069 | 10.236 | 0 | 0 | 0 | 0 | 0 | 9.356 | 0 | 9.667 | 15.179 | 0 | 0 |
| SKNSH20030640 | 0 | 0 | 0 | 0 | 26.755 | 0 | 0 | 16.987 | 0 | 0 | 0 | 0 | 0 |
| SKNSH20094350 | 19.559 | 0 | 0 | 0 | 0 | 0 | 0 | 0 | 0 | 0 | 0 | 0 |
| SMINT20000070 | 0 | 18.929 | 0 | 0 | 0 | 0 | 0 | 0 | 0 | 0 | 0 | 0 |
| SMINT20002320 | 0 | 0 | 39.676 | 0 | 0 | 0 | 0 | 0 | 0 | 0 | 0 | 0 |
| SMINT20030740 | 2.994 | 0 | 0 | 0 | 0 | 0 | 0 | 0 | 0 | 0 | 0 | 0 |
| SMINT20039050 | 0 | 0 | 0 | 0 | 0 | 0 | 0 | 5.94 | 0 | 0 | 0 | 0 | 25.802 |
| SMINT20045890 | 0 | 0 | 0 | 0 | 0 | 11.467 | 0 | 0 | 0 | 0 | 0 | 0 |
| SMINT20047290 | 20.756 | 0 | 0 | 0 | 0 | 0 | 0 | 0 | 0 | 0 | 0 | 0 |
| SMINT20048720 | 0 | 0 | 0 | 16.241 | 0 | 0 | 0 | 7.849 | 12.12 | 0 | 0 | 0 |
| SMINT20056240 | 12.1 | 16.438 | 0 | 0 | 0 | 0 | 0 | 0 | 0 | 0 | 0 | 0 |
| SMINT20077920 | 29.636 | 11.503 | 0 | 5.439 | 0 | 5.246 | 18.009 | 0 | 8.118 | 5.432 | 8.529 | 0 | 0 |
| SMINT20088690 | 0 | 0 | 0 | 0 | 0 | 0 | 0 | 0 | 50.098 | 0 | 0 | 0 |
| SMINT20089210 | 5.552 | 0 | 0 | 7.133 | 0 | 0 | 0 | 0 | 0 | 7.123 | 22.369 | 10.807 | 0 |
| SMINT20089600 | 0 | 0 | 0 | 0 | 0 | 18.533 | 0 | 0 | 28.682 | 0 | 0 | 0 |
| SMINT20094150 | 0 | 0 | 0 | 0 | 0 | 0 | 0 | 0 | 0 | 0 | 0 | 73.849 |
| SPLEN20005160 | 0 | 0 | 38.129 | 0 | 0 | 0 | 0 | 0 | 0 | 25.071 | 0 | 0 | 0 |
| SPLEN20005370 | 0 | 0 | 0 | 0 | 0 | 0 | 69.313 | 0 | 0 | 0 | 0 | 0 |
| SPLEN20012450 | 0 | 0 | 0 | 0 | 0 | 0 | 0 | 0 | 0 | 0 | 0 | 34.138 |

TABLE 34

| | | | | | | | | | | | | |
|---|---|---|---|---|---|---|---|---|---|---|---|---|
| SPLEN20024930 | 0 | 0 | 0 | 24.956 | 0 | 0 | 0 | 0 | 0 | 12.461 | 0 | 0 | 0 |
| SPLEN20040780 | 32.496 | 0 | 31.704 | 0 | 0 | 0 | 0 | 0 | 0 | 0 | 0 | 0 |
| SPLEN20048800 | 0 | 0 | 0 | 0 | 0 | 0 | 0 | 0.678 | 0 | 0 | 0 | 0 |
| SPLEN20055600 | 0 | 0 | 0 | 0 | 0 | 0 | 0 | 0 | 67.066 | 0 | 0 | 0 |
| SPLEN20057830 | 0 | 0 | 0 | 0 | 0 | 0 | 32.073 | 18.727 | 0 | 0 | 0 | 0 |
| SPLEN20063250 | 0 | 0 | 0 | 0 | 0 | 0 | 0 | 0 | 0 | 0 | 4.267 | 0 | 0 |
| SPLEN20071820 | 0 | 0 | 0 | 0 | 0 | 0 | 0 | 0 | 0 | 0 | 37.578 | 0 | 0 |
| SPLEN20073880 | 0 | 0 | 0 | 0 | 0 | 0 | 0 | 0 | 28.031 | 0 | 0 | 0 |
| SPLEN20076470 | 8.519 | 0 | 0 | 0 | 0 | 0 | 0 | 0 | 0 | 0 | 0 | 0 |
| SPLEN20104690 | 0 | 0 | 0 | 0 | 0 | 0 | 0 | 56.874 | 0 | 0 | 0 | 0 |
| SPLEN20114190 | 0 | 0 | 0 | 0 | 0 | 0 | 0 | 0 | 0 | 57.672 | 0 | 0 |
| SPLEN20125230 | 0 | 0 | 0 | 21.397 | 0 | 0 | 0 | 41.362 | 0 | 0 | 0 | 0 |
| SPLEN20135030 | 0 | 0 | 0 | 0 | 0 | 0 | 0 | 20.858 | 0 | 0 | 0 | 0 |
| SPLEN20136700 | 0 | 0 | 0 | 22.036 | 0 | 0 | 0 | 0 | 0 | 22.006 | 0 | 0 |
| SPLEN20175920 | 0 | 0 | 0 | 57.706 | 0 | 0 | 0 | 0 | 0 | 0 | 0 | 0 |
| SPLEN20181570 | 3.585 | 0 | 0 | 0 | 0 | 0 | 0 | 0 | 0 | 0 | 0 | 0 |
| SPLEN20183020 | 0 | 0 | 0 | 0 | 0 | 0 | 0 | 0 | 0 | 21.246 | 0 | 0 |
| SPLEN20187490 | 0 | 0 | 0 | 0 | 0 | 0 | 0 | 22.776 | 0 | 0 | 0 | 0 |
| SPLEN20193490 | 0 | 0 | 0 | 0 | 0 | 0 | 0 | 0 | 0 | 57.672 | 0 | 0 |
| SPLEN20193790 | 0 | 0 | 0 | 0 | 0 | 0 | 0 | 0 | 0 | 0 | 0 | 10.329 |

TABLE 34-continued

| | | | | | | | | | | | | | |
|---|---|---|---|---|---|---|---|---|---|---|---|---|---|
| SPLEN20197740 | 0 | 0 | 0 | 0 | 0 | 0 | 0 | 0 | 0 | 0 | 33.067 | 0 | 0 |
| SPLEN20200070 | 0 | 0 | 0 | 0 | 67.502 | 0 | 0 | 0 | 0 | 0 | 0 | 0 | 0 |
| SPLEN20200340 | 0 | 0 | 0 | 0 | 40.827 | 0 | 0 | 0 | 0 | 0 | 0 | 0 | 0 |
| TESOP10000350 | 0 | 0 | 0 | 0 | 0 | 0 | 0 | 2.374 | 0 | 0 | 0 | 3.721 | 0 |
| TESTI20005980 | 0 | 0 | 0 | 28.345 | 0 | 0 | 0 | 0 | 0 | 0 | 0 | 0 | 0 |
| TESTI20030440 | 0 | 0 | 0 | 0 | 0 | 0 | 0 | 0 | 0 | 0 | 27.24 | 0 | 0 |
| TESTI20030610 | 0 | 0 | 0 | 0 | 0 | 7.709 | 0 | 7.726 | 0 | 0 | 0 | 0 | 0 |
| TESTI20031410 | 0 | 0 | 0 | 0 | 0 | 19.238 | 0 | 0 | 0 | 0 | 0 | 15.113 | 0 |
| TESTI20035330 | 4.698 | 0 | 0 | 0 | 0 | 5.821 | 0 | 5.835 | 0 | 0 | 0 | 0 | 25.343 |
| TESTI20047370 | 0 | 0 | 0 | 0 | 0 | 0 | 0 | 0 | 3.037 | 0 | 0 | 0 | 0 |
| TESTI20050400 | 56.537 | 0 | 0 | 0 | 0 | 0 | 0 | 0 | 0 | 0 | 0 | 0 | 0 |
| TESTI20050720 | 0 | 0 | 0 | 6.04 | 0 | 0 | 0 | 0 | 0 | 0 | 0 | 0 | 0 |
| TESTI20053780 | 56.537 | 0 | 0 | 0 | 0 | 0 | 0 | 0 | 0 | 0 | 0 | 0 | 0 |
| TESTI20057430 | 0 | 0 | 0 | 5.84 | 0 | 0 | 0 | 5.644 | 0 | 0 | 0 | 0 | 0 |
| TESTI20057590 | 0 | 0 | 0 | 0 | 0 | 5.433 | 0 | 0 | 8.409 | 0 | 0 | 0 | 0 |
| TESTI20057840 | 0 | 0 | 0 | 0 | 0 | 0 | 0 | 61.764 | 0 | 0 | 0 | 0 | 0 |
| TESTI20057880 | 0 | 0 | 0 | 15.638 | 0 | 0 | 0 | 0 | 0 | 0 | 0 | 0 | 0 |

TABLE 35

| | | | | | | | | | | | | | |
|---|---|---|---|---|---|---|---|---|---|---|---|---|---|
| TESTI20059080 | 0 | 5.993 | 0 | 0 | 25.882 | 0 | 0 | 5.478 | 8.458 | 0 | 0 | 0 | 0 |
| TESTI20061200 | 0 | 9.745 | 0 | 0 | 0 | 8.888 | 0 | 0 | 0 | 0 | 0 | 0 | 0 |
| TESTI20062580 | 0 | 0 | 0 | 0 | 0 | 0 | 31.15 | 0 | 28.084 | 0 | 29.506 | 0 | 0 |
| TESTI20063410 | 0 | 0 | 0 | 9.861 | 0 | 9.51 | 0 | 0 | 14.718 | 9.848 | 0 | 0 | 0 |
| TES1120064530 | 0 | 0 | 0 | 0 | 0 | 2.635 | 0 | 0 | 0 | 5.458 | 0 | 0 | 0 |
| TESTI20066280 | 0 | 0 | 0 | 0 | 0 | 0 | 33.259 | 0 | 0 | 0 | 0 | 0 | 0 |
| TESTI20067480 | 9.289 | 6.31 | 0 | 11.934 | 0 | 0 | 0 | 5.768 | 0 | 0 | 0 | 0 | 0 |
| TESTI20071630 | 0 | 0 | 0 | 62.564 | 0 | 0 | 0 | 0 | 0 | 0 | 0 | 0 | 0 |
| TESTI20079980 | 6.472 | 8.793 | 6.314 | 0 | 0 | 4.009 | 6.883 | 12.056 | 0 | 4.152 | 0 | 0 | 0 |
| TESTI20081890 | 0 | 0 | 0 | 0 | 0 | 61.711 | 0 | 0 | 0 | 0 | 0 | 0 | 0 |
| TESTI20089290 | 0 | 63.862 | 0 | 0 | 0 | 0 | 0 | 0 | 0 | 0 | 0 | 0 | 0 |
| TESTI20090180 | 0 | 0 | 0 | 21.786 | 0 | 0 | 0 | 0 | 0 | 0 | 0 | 0 | 0 |
| TESTI20105130 | 2.549 | 0 | 2.487 | 0 | 4.986 | 0 | 0 | 1.583 | 0 | 1.635 | 0 | 0 | 0 |
| TESTI20106170 | 0 | 18.661 | 13.402 | 0 | 0 | 8.51 | 14.608 | 0 | 0 | 26.436 | 0 | 0 | 0 |
| TESTI20121040 | 0 | 0 | 0 | 18.021 | 0 | 0 | 0 | 0 | 0 | 0 | 0 | 0 | 0 |
| TESTI20150920 | 0 | 0 | 0 | 0 | 17.606 | 0 | 0 | 0 | 17.261 | 0 | 18.135 | 0 | 0 |
| TESTI20169500 | 17.008 | 0 | 0 | 0 | 0 | 0 | 0 | 0 | 0 | 0 | 0 | 0 | 0 |
| TESTI20193080 | 0 | 0 | 0 | 0 | 0 | 0 | 0 | 0 | 0 | 62.532 | 0 | 0 | 0 |
| TESTI20215310 | 0 | 0 | 0 | 0 | 0 | 0 | 0 | 0 | 0 | 0 | 0 | 71.689 | 0 |
| TESTI20221790 | 0 | 0 | 0 | 0 | 0 | 0 | 37.573 | 0 | 0 | 0 | 0 | 0 | 0 |
| TESTI20245860 | 0 | 0 | 0 | 62.564 | 0 | 0 | 0 | 0 | 0 | 0 | 0 | 0 | 0 |
| TESTI20252690 | 0 | 33.792 | 0 | 0 | 0 | 0 | 0 | 0 | 0 | 0 | 0 | 0 | 0 |
| TESTI20254090 | 0 | 0 | 0 | 0 | 0 | 12.041 | 0 | 24.136 | 18.635 | 0 | 0 | 0 | 0 |
| TESTI20261160 | 0 | 0 | 0 | 0 | 0 | 0 | 0 | 35 | 0 | 0 | 0 | 0 | 0 |
| TESTI20262150 | 0 | 0 | 42.353 | 0 | 0 | 0 | 0 | 0 | 0 | 0 | 0 | 0 | 0 |
| TESTI20274960 | 0 | 0 | 0 | 0 | 0 | 0 | 0 | 0 | 0 | 38.341 | 0 | 0 | 0 |
| THYMU20007750 | 0 | 0 | 0 | 29.606 | 0 | 0 | 0 | 0 | 0 | 0 | 0 | 0 | 0 |
| THYMU20009460 | 0 | 16.274 | 0 | 0 | 0 | 0 | 0 | 0 | 0 | 0 | 0 | 0 | 0 |
| THYMU20009710 | 0 | 0 | 0 | 0 | 0 | 0 | 0 | 0 | 0 | 0 | 0 | 0 | 83.62 |
| THYMU20019260 | 15.885 | 0 | 0 | 0 | 0 | 0 | 0 | 0 | 30.461 | 0 | 0 | 0 | 0 |
| THYMU20028410 | 13.579 | 0 | 0 | 0 | 0 | 16.825 | 0 | 0 | 0 | 0 | 0 | 0 | 0 |
| THYMU20030460 | 0 | 0 | 0 | 4.612 | 0 | 0 | 0 | 0 | 0 | 4.606 | 0 | 0 | 0 |
| THYMU20031330 | 0 | 0 | 0 | 0 | 0 | 0 | 0 | 0 | 0 | 0 | 0 | 0 | 39.843 |
| THYMU20043440 | 0 | 0 | 0 | 0 | 0 | 29.394 | 0 | 0 | 0 | 0 | 0 | 0 | 0 |
| THYMU20044100 | 0 | 0 | 0 | 28.394 | 0 | 0 | 0 | 27.444 | 0 | 0 | 0 | 0 | 0 |
| THYMU20044520 | 0 | 28.839 | 0 | 0 | 0 | 26.302 | 0 | 0 | 0 | 0 | 0 | 0 | 0 |
| THYMU20049060 | 0 | 0 | 0 | 0 | 0 | 0 | 0 | 0 | 64.474 | 0 | 0 | 0 | 0 |

TABLE 36

| | | | | | | | | | | | | | |
|---|---|---|---|---|---|---|---|---|---|---|---|---|---|
| THYMU20055460 | 5.716 | 0 | 5.577 | 0 | 0 | 0 | 0 | 0 | 0 | 3.667 | 0 | 11.127 | 0 |
| THYMU20055740 | 0 | 0 | 0 | 54.873 | 0 | 0 | 0 | 0 | 0 | 0 | 0 | 0 | 0 |
| THYMU20071120 | 3.627 | 0 | 3.539 | 0 | 0 | 0 | 0 | 0 | 0 | 0 | 0 | 0 | 0 |
| THYMU20078020 | 0 | 56.251 | 0 | 0 | 0 | 0 | 0 | 0 | 0 | 0 | 0 | 0 | 0 |
| THYMU20089900 | 0 | 0 | 0 | 0 | 0 | 0 | 0 | 0 | 0 | 0 | 30.29 | 0 | 0 |
| THYMU20091040 | 0 | 0 | 0 | 0 | 0 | 25.102 | 0 | 0 | 19.425 | 0 | 20.408 | 0 | 0 |

TABLE 36-continued

| Clone ID | 1 | 2 | 3 | 4 | 5 | 6 | 7 | 8 | 9 | 10 | 11 | 12 | 13 |
|---|---|---|---|---|---|---|---|---|---|---|---|---|---|
| THYMU20104480 | 0 | 0 | 22.379 | 0 | 0 | 14.21 | 0 | 0 | 0 | 0 | 0 | 0 | 0 |
| THYMU20120240 | 7.548 | 0 | 0 | 0 | 0 | 0 | 0 | 0 | 0 | 0 | 0 | 0 | 0 |
| THYMU20139160 | 1.433 | 0.649 | 0.932 | 1.841 | 1.868 | 2.958 | 2.031 | 2.965 | 3.663 | 2.451 | 0 | 0 | 0 |
| THYMU20143230 | 0 | 0 | 0 | 0 | 0 | 53.973 | 0 | 0 | 0 | 0 | 0 | 0 | 0 |
| THYMU20150190 | 0 | 0 | 0 | 0 | 0 | 0 | 0 | 0 | 15.366 | 0 | 0 | 0 | 43.225 |
| THYMU20157620 | 0 | 0 | 0 | 0 | 0 | 0 | 0 | 10.687 | 0 | 0 | 0 | 16.752 | 0 |
| THYMU20176010 | 48.624 | 0 | 0 | 0 | 0 | 0 | 0 | 0 | 0 | 0 | 0 | 0 | 0 |
| TKIDN10001920 | 15.885 | 0 | 0 | 0 | 0 | 0 | 0 | 0 | 30.461 | 0 | 0 | 0 | 0 |
| TRACH20012490 | 0 | 0 | 0 | 0 | 0 | 8.484 | 0 | 0 | 0 | 0 | 0 | 0 | 0 |
| TRACH20021000 | 0 | 14.835 | 0 | 0 | 0 | 0 | 0 | 0 | 0 | 0 | 0 | 0 | 58.903 |
| TRACH20026640 | 0 | 0 | 0 | 7.419 | 0 | 0 | 0 | 0 | 0 | 0 | 0 | 0 | 0 |
| TRACH20058000 | 0 | 0 | 0 | 0 | 0 | 23.543 | 0 | 0 | 0 | 0 | 0 | 0 | 0 |
| TRACH20090060 | 0 | 0 | 0 | 0 | 0 | 6.122 | 0 | 0 | 0 | 0 | 0 | 0 | 0 |
| TRACH20159390 | 0 | 0 | 0 | 0 | 0 | 0 | 0 | 34.053 | 0 | 0 | 0 | 0 | 0 |
| UMVEN10001380 | 0 | 0 | 3.528 | 0 | 0 | 0 | 0 | 0 | 0 | 0 | 0 | 0 | 0 |
| UTERU10001060 | 15.424 | 0 | 0 | 0 | 0 | 0 | 32.805 | 0 | 0 | 0 | 0 | 0 | 0 |
| UTERU20000230 | 0 | 0 | 0 | 21.808 | 0 | 0 | 0 | 0 | 0 | 21.777 | 0 | 0 | 0 |
| UTERU20000950 | 1.882 | 2.557 | 0 | 2.418 | 0 | 2.332 | 4.002 | 0 | 0 | 4.829 | 0 | 0 | 0 |
| UT2RU20026620 | 5.456 | 7.413 | 10.647 | 0 | 0 | 0 | 0 | 0 | 0 | 0 | 0 | 0 | 0 |
| UTERU20041970 | 0 | 0 | 3.112 | 0 | 0 | 3.953 | 0 | 0 | 0 | 0 | 0 | 3.105 | 0 |
| UTERU20065470 | 0 | 0 | 0 | 0 | 0 | 0 | 0 | 0 | 0 | 0 | 49.42 | 0 | 0 |
| UTERU20079240 | 0 | 0 | 0 | 0 | 19.675 | 0 | 0 | 0 | 0 | 0 | 20.266 | 19.583 | 0 |
| UTERU20083020 | 0 | 0 | 0 | 0 | 0 | 4.664 | 8.006 | 4.675 | 7.218 | 4.83 | 7.584 | 7.328 | 0 |
| UTERU20089300 | 0 | 0 | 0 | 0 | 0 | 0 | 0 | 0 | 0 | 0 | 0 | 0 | 72.345 |
| UTERU20089390 | 8.519 | 0 | 0 | 0 | 0 | 0 | 0 | 0 | 0 | 0 | 0 | 0 | 0 |
| UTERU20095100 | 19.272 | 0 | 0 | 0 | 0 | 0 | 40.989 | 0 | 0 | 0 | 0 | 0 | 0 |
| UTERU20102260 | 0 | 0 | 0 | 15.526 | 0 | 0 | 0 | 0 | 0 | 0 | 0 | 0 | 0 |
| UTERU20103200 | 0 | 0 | 0 | 0 | 0 | 0 | 0 | 48.185 | 0 | 0 | 0 | 0 | 0 |
| UTERU20127150 | 0 | 0 | 0 | 0 | 0 | 0 | 37.588 | 0 | 0 | 0 | 0 | 0 | 0 |
| UTERU20128560 | 0 | 0 | 0 | 11.256 | 0 | 0 | 0 | 0 | 0 | 0 | 0 | 0 | 0 |

TABLE 37

| Clone ID | FEHRT | HEART |
|---|---|---|
| BRAMY20043630 | 0 | 7.465 |
| BRAMY20072870 | 0 | 76.411 |
| BRAMY20227860 | 0 | 2.943 |
| BRAWH20093070 | 0 | 25.522 |
| BRCAN10001680 | 0 | 14.799 |
| FCBBF30053300 | 86.185 | 0 |
| FEBRA20078800 | 0 | 33.301 |
| FEBRA20090220 | 0 | 9.681 |
| HCHON20000870 | 0 | 23.022 |
| HEART10001420 | 0 | 100 |
| HEART10001490 | 0 | 14.37 |
| HEART20009590 | 0 | 100 |
| HEART20019310 | 0 | 100 |
| HEART20022200 | 0 | 100 |
| HEART20031680 | 0 | 100 |
| HEART20047640 | 0 | 100 |
| HEART20063100 | 0 | 100 |
| HEART20082570 | 0 | 100 |
| HLUNG20083960 | 0 | 40.294 |
| PLACE60088240 | 0 | 67.95 |
| PLACE60120280 | 0 | 50.712 |
| PROST20016760 | 0 | 8.491 |
| PROST20035170 | 0 | 23.745 |
| PROST20062820 | 0 | 67.646 |
| PROST20127450 | 0 | 48.135 |
| SKMUS20006790 | 0 | 5.186 |
| SKMUS20008730 | 0 | 27.003 |
| TESTI20270130 | 0 | 83.925 |

TABLE 38

| Clone ID | FEKID | KIDNE |
|---|---|---|
| ASTRO20009140 | 0 | 19.518 |
| BGGI120010750 | 0 | 4.532 |
| BRACE20054480 | 0 | 29.719 |
| BRACE20062580 | 0 | 2.613 |
| BRACE20219360 | 0 | 59.494 |
| BRAMY20001510 | 68.103 | 0 |
| BRAMY20003540 | 0 | 4.676 |
| BRAMY20003880 | 0 | 16.882 |
| BRAMY20043630 | 0 | 3.51 |
| BRAMY20204270 | 0 | 3.618 |
| CTONG20033750 | 0 | 59.93 |
| CTONG20039370 | 0 | 59.93 |
| CTONG20045500 | 0 | 59.93 |
| FCBBF20023490 | 0 | 14.59 |
| FEBRA20039260 | 0 | 7.084 |
| FEBRA20040290 | 0 | 7.711 |
| HEART10001490 | 0 | 20.269 |
| HLUNG20041590 | 0 | 4.744 |
| HLUNG20068120 | 0 | 11.84 |
| HLUNG20072450 | 88.657 | 3.599 |
| HLUNG20083960 | 0 | 18.946 |
| KIDNE20011600 | 0 | 100 |
| KIDNE20016360 | 0 | 59.589 |
| KIDNE20024380 | 0 | 100 |
| KIDNE20027980 | 0 | 100 |
| KIDNE20080690 | 0 | 5.861 |
| KIDNE20081170 | 0 | 100 |
| KIDNE20083150 | 0 | 100 |
| KIDNE20083620 | 0 | 100 |
| KIDNE20084030 | 0 | 40.03 |
| KIDNE20084040 | 0 | 34.084 |
| KIDNE20084730 | 0 | 100 |
| KIDNE20084800 | 0 | 100 |
| KIDNE20086490 | 0 | 87.61 |
| KIDNE20086660 | 0 | 47.013 |
| KIDNE20086970 | 0 | 100 |
| KIDNE20087880 | 0 | 28.683 |
| KIDNE20088240 | 0 | 100 |
| KIDNE20089870 | 0 | 3.987 |
| KIDNE20091090 | 0 | 100 |
| KIDNE20094260 | 0 | 100 |
| KIDNE20094670 | 0 | 59.494 |

TABLE 38-continued

| Clone ID | FEKID | KIDNE |
|---|---|---|
| KIDNE20095530 | 0 | 100 |
| KIDNE20133460 | 0 | 100 |
| KIDNE20133880 | 0 | 100 |
| KIDNE20134130 | 0 | 65.363 |
| KIDNE20134890 | 0 | 100 |
| KIDNE20137310 | 0 | 100 |
| KIDNE20138450 | 0 | 38.971 |
| KIDNE20140870 | 0 | 22.93 |
| KIDNE20141120 | 0 | 100 |
| KIDNE20141700 | 0 | 100 |
| KIDNE20142680 | 0 | 100 |
| KIDNE20142900 | 0 | 31.732 |
| KIDNE20143200 | 0 | 100 |
| KIDNE20147170 | 0 | 100 |
| KIDNE20148080 | 0 | 100 |
| KIDNE20149780 | 0 | 60.365 |
| KIDNE20150730 | 0 | 100 |
| KIDNE20152440 | 0 | 100 |
| KIDNE20154330 | 0 | 100 |
| KIDNE20154830 | 0 | 100 |
| KIDNE20155980 | 0 | 100 |
| KIDNE20157100 | 0 | 100 |
| KIDNE20160360 | 0 | 100 |
| KIDNE20160960 | 0 | 100 |
| KIDNE20163710 | 0 | 100 |
| KIDNE20165390 | 0 | 100 |
| KIDNE20169180 | 0 | 100 |
| KIDNE20170400 | 0 | 19.556 |
| KIDNE20173150 | 0 | 100 |
| KIDNE20173430 | 0 | 36.673 |
| KIDNE20176030 | 0 | 100 |
| KIDNE20181670 | 0 | 100 |
| KIDNE20182540 | 0 | 100 |
| KIDNE20186170 | 0 | 100 |
| KIDNE20188630 | 0 | 100 |
| KIDNE20189890 | 0 | 100 |
| KIDNE20189960 | 0 | 100 |
| KIDNE20191870 | 0 | 100 |
| OCBBF20174890 | 0 | 32.241 |
| PLACE60073090 | 0 | 10.501 |
| PLACE60181870 | 0 | 49.921 |
| PROST20016760 | 0 | 3.992 |
| PUAEN10000650 | 0 | 6.676 |
| SKNMC20006350 | 24.429 | 0 |
| SPLEN20017610 | 0 | 42.429 |
| SPLEN20063250 | 0 | 3.996 |
| SPLEN20126110 | 0 | 50.05 |
| SPLEN20135030 | 0 | 31.695 |
| TESTI20061200 | 0 | 13.537 |
| TESTI20262150 | 0 | 40.96 |
| THYMU10004280 | 0 | 3.534 |
| THYMU20139160 | 0 | 2.704 |
| TRACH20011010 | 0 | 10.647 |

TABLE 39

| Clone ID | FELNG | HLUNG |
|---|---|---|
| BRAMY20001510 | 0 | 5.948 |
| BRAMY20043630 | 0 | 15.102 |
| BRAMY20204270 | 0 | 7.785 |
| BRAMY20227860 | 0 | 1.488 |
| CTONG20029030 | 0 | 28.504 |
| CTONG20168460 | 0 | 76.291 |
| CTONG20186290 | 0 | 61.67 |
| FEBRA20039260 | 0 | 7.62 |
| FEBRA20078800 | 0 | 33.686 |
| FEBRA20163980 | 0 | 38.327 |
| HCHON20000870 | 0 | 23.288 |
| HLUNG20008460 | 0 | 67.54 |
| HLUNG20009260 | 0 | 100 |
| HLUNG20009550 | 0 | 100 |
| HLUNG20010130 | 0 | 100 |

TABLE 39-continued

| Clone ID | FELNG | HLUNG |
|---|---|---|
| HLUNG20011260 | 0 | 100 |
| HLUNG20011440 | 0 | 100 |
| HLUNG20011460 | 0 | 76.577 |
| HLUNG20012140 | 0 | 100 |
| HLUNG20014590 | 0 | 36.045 |
| HLUNG20015070 | 0 | 17.804 |
| HLUNG20015180 | 0 | 4.723 |
| HLUNG20020500 | 0 | 100 |
| HLUNG20020850 | 0 | 67.488 |
| HLUNG20021450 | 0 | 68.006 |
| HLUNG20023030 | 0 | 100 |
| HLUNG20024050 | 0 | 100 |
| HLUNG20025620 | 0 | 100 |
| HLUNG20028110 | 0 | 76.618 |
| HLUNG20029420 | 0 | 100 |
| HLUNG20029490 | 0 | 81.173 |
| HLUNG20030420 | 0 | 100 |
| HLUNG20030490 | 0 | 100 |
| HLUNG20030610 | 0 | 100 |
| HLUNG20031620 | 0 | 80.237 |
| HLUNG20032460 | 0 | 44.037 |
| HLUNG20033060 | 0 | 36.529 |
| HLUNG20033310 | 0 | 100 |
| HLUNG20033350 | 0 | 100 |
| HLUNG20034970 | 0 | 79.349 |
| HLUNG20037140 | 0 | 100 |
| HLUNG20037160 | 0 | 100 |
| HLUNG20037780 | 0 | 44.761 |
| HLUNG20038330 | 0 | 100 |
| HLUNG20041540 | 0 | 100 |
| HLUNG20041590 | 0 | 10.207 |
| HLUNG20042730 | 0 | 100 |
| HLUNG20045340 | 0 | 7.67 |
| HLUNG20047070 | 0 | 100 |
| HLUNG20050760 | 0 | 100 |
| HLUNG20051330 | 0 | 100 |
| HLUNG20052300 | 0 | 23.611 |
| HLUNG20054790 | 0 | 100 |
| HLUNG20055240 | 0 | 100 |
| HLUNG20056560 | 0 | 75.961 |
| HLUNG20057380 | 0 | 100 |
| HLUNG20059240 | 0 | 100 |
| HLUNG20060670 | 0 | 100 |
| HLUNG20063700 | 0 | 100 |
| HLUNG20065700 | 0 | 62.8 |
| HLUNG20065990 | 0 | 100 |
| HLUNG20067810 | 0 | 100 |
| HLUNG20068120 | 0 | 50.947 |
| HLUNG20069350 | 0 | 100 |
| HLUNG20070410 | 0 | 100 |
| HLUNG20072100 | 0 | 54.241 |
| HLUNG20072190 | 0 | 79.349 |
| HLUNG20072450 | 0 | 7.744 |
| HLUNG20074330 | 0 | 100 |
| HLUNG20079310 | 0 | 100 |
| HLUNG20081390 | 0 | 66.429 |
| HLUNG20081530 | 0 | 100 |
| HLUNG20082350 | 0 | 100 |
| HLUNG20083330 | 0 | 100 |
| HLUNG20083480 | 0 | 13.123 |
| HLUNG20083840 | 0 | 100 |
| HLUNG20083960 | 0 | 40.76 |
| HLUNG20084790 | 0 | 100 |
| HLUNG20085210 | 0 | 50.993 |
| HLUNG20088750 | 0 | 100 |
| HLUNG20092530 | 0 | 100 |
| HLUNG20093030 | 0 | 100 |
| HLUNG20094130 | 0 | 75.987 |
| KIDNE20142900 | 0 | 68.268 |
| PROST20016760 | 0 | 8.589 |
| PROST20052850 | 0 | 57.701 |
| SKNMC20006350 | 0 | 2.134 |
| SMINT20035050 | 0 | 6.135 |
| SPLEN20012450 | 0 | 25.695 |
| TESTI20057590 | 0 | 17.804 |
| TESTI20061200 | 0 | 29.123 |
| TESTI20067480 | 0 | 18.856 |

TABLE 39-continued

| Clone ID | FELNG | HLUNG |
|---|---|---|
| TESTI20116050 | 0 | 30.168 |
| THYMU10004280 | 0 | 7.603 |
| THYMU20010180 | 0 | 79.349 |
| THYMU20139160 | 0 | 1.939 |
| TRACH20011010 | 0 | 22.907 |
| UTERU20016580 | 0 | 43.64 |
| UTERU20127030 | 0 | 66.318 |

TABLE 40

Alteration of the expression level of each clone due to TNF-α stimulation to human monocyte cell line THP-1 and alteration of the expression level of each clone due to co-culture of gastric cancer cell line MKN45 with *Helicobacter pylori*. ctl, TNF__1h, and TNF__3 h in the column of THP-1, respectively, indicate the relative mRNA expression levels in unstimulated THP-1, in the cell stimulated with 10 ng/mL TNF-α for 1 hour, and in the cell stimulated with 10 ng/mL TNF-α for 3 hours; ctl, Hp, and ΔcagE in the column of MKN45 indicate the relative mRNA expression levels in MKN45 cultured without *Helicobacter pylori*, in the cells co-cultured with cag PAI-positive *Helicobacter pylori* (TN2) (at a ratio of MKN45:TN2=1:100 cells (colonies)) for 3 hours, and in the cells co-cultured with the cagE mutant (TN2ΔcagE) (at a ratio of MKN45:TN2ΔcagE=1:100 cells (colonies)) for 3 hours, respectively. [ATAC-PCR]

| Clone name | THP-1 ctl | TNF__1h | TNF__3h | MKN45 ctl | Hp | ΔcagE |
|---|---|---|---|---|---|---|
| ASTRO20045840 | 1.5 | 2.3 | 1.9 | 2.3 | 2.4 | 0.2 |
| ASTRO20055930 | 0.8 | 1.9 | 1.4 | 0.8 | 0.8 | 0.5 |
| ASTRO20088950 | 1.0 | 0.2 | 2.5 | 1.1 | 0.3 | 0.3 |
| BNGH420052350 | 2.2 | 2.2 | 0.0 | 0.5 | 0.5 | 3.2 |
| BRACE20052530 | 2.6 | 1.0 | 0.3 | 2.2 | 1.0 | 0.9 |
| BRACE20054080 |  |  |  | 0.8 | 1.1 | 1.0 |
| BRAMY20003880 | 1.5 | 0.9 | 0.6 | 1.2 | 0.0 | 1.3 |
| BRAMY20027390 | 0.6 | 4.2 | 0.1 | 2.9 | 0.4 | 0.1 |
| BRAMY20028530 |  |  |  | 0.5 | 3.4 | 4.1 |
| BRAMY20035380 | 1.3 | 0.9 | 0.8 | 0.5 | 1.7 | 0.5 |
| BRAMY20036530 |  |  |  | 1.1 | 0.3 | 0.3 |
| BRAMY20050940 | 0.4 | 0.0 | 0.0 | 0.2 | 0.2 | 1.0 |
| BRAMY20072440 |  |  |  | 0.5 | 0.5 | 0.1 |
| BRAMY20096930 | 3.8 | 5.2 | 4.7 | 1.7 | 2.4 | 1.7 |
| BRAMY20118410 | 0.8 | 3.7 | 0.8 | 2.7 | 0.0 | 0.0 |
| BRAMY20237190 | 0.0 | 2.3 | 0.1 |  |  |  |
| BRAWH20055330 | 2.5 | 4.7 | 2.8 | 1.2 | 1.3 | 0.0 |
| BRAWH20078620 |  |  |  | 1.9 | 1.2 | 1.0 |
| BRAWH20190530 | 0.6 | 0.1 | 0.0 | 0.3 | 0.0 | 0.0 |
| BRCAN20001480 | 1.0 | 3.4 | 4.1 | 1.4 | 1.6 | 0.6 |
| BRHIP10000720 | 0.3 | 1.8 | 1.4 | 0.9 | 0.0 | 1.7 |
| BRHIP10001040 | 0.9 | 0.7 | 0.1 | 0.0 | 0.1 | 0.0 |
| BRHIP20000210 | 0.6 | 0.6 | 0.0 | 2.0 | 0.3 | 0.0 |
| BRSSN20001970 | 0.8 | 1.4 | 1.3 | 0.8 | 0.7 | 0.5 |
| BRSSN20091190 |  |  |  | 0.6 | 0.1 | 0.8 |
| CD34C20001750 | 0.0 | 0.4 | 2.0 |  |  |  |
| CTONG20078340 | 0.3 | 2.6 | 1.6 | 0.9 | 0.7 | 2.4 |
| CTONG20079590 | 1.0 | 1.2 | 0.2 | 0.1 | 0.0 | 0.0 |
| CTONG20083980 | 0.0 | 0.0 | 0.0 | 1.3 | 1.8 | 1.9 |
| CTONG20085210 | 0.8 | 1.2 | 2.3 | 0.1 | 0.2 | 0.1 |
| DFNES20063460 | 1.7 | 3.6 | 2.7 | 1.3 | 2.0 | 0.1 |
| DFNES20072990 | 1.4 | 1.9 | 2.0 | 5.0 | 4.9 | 4.2 |
| FCBBF20029280 | 1.8 | 5.5 | 3.8 | 2.3 | 2.2 | 2.3 |
| FCBBF20032930 | 0.1 | 0.1 | 0.0 | 1.7 | 0.5 | 0.5 |
| FCBBF20036360 | 0.6 | 0.7 | 0.4 | 0.4 | 0.2 | 0.2 |
| FCBBF30022680 | 2.9 | 1.0 | 0.3 | 2.9 | 1.0 | 0.3 |
| FCBBF30078600 | 1.1 | 2.6 | 0.6 |  |  |  |
| FCBBF30105080 | 1.8 | 1.6 | 1.9 | 0.2 | 0.1 | 0.0 |
| FCBBF30169870 | 1.1 | 1.2 | 0.2 | 1.6 | 0.3 | 0.3 |
| FCBBF30225930 | 2.2 | 0.8 | 1.0 | 1.1 | 0.7 | 0.2 |
| FCBBF50000610 | 2.1 | 2.8 | 2.2 | 2.0 | 2.2 | 1.3 |
| FEBRA20007820 | 0.0 | 1.7 | 2.4 | 2.1 | 1.4 | 1.2 |
| FEBRA20031280 | 0.1 | 1.8 | 4.5 | 0.5 | 0.0 | 0.0 |
| FEBRA20031810 | 1.4 | 3.9 | 1.5 | 1.5 | 2.1 | 1.9 |
| FEBRA20039260 | 2.0 | 3.0 | 2.5 |  |  |  |
| FEBRA20046280 | 1.3 | 0.3 | 0.3 |  |  |  |
| FEBRA20084750 |  |  |  | 2.5 | 2.2 | 0.3 |
| FEBRA20182030 | 3.0 | 4.0 | 4.2 | 1.6 | 0.3 | 0.7 |
| HLUNG20041540 | 0.0 | 2.2 | 2.2 | 1.9 | 2.4 | 0.2 |
| HLUNG20092530 | 0.3 | 0.3 | 3.1 | 0.2 | 0.2 | 0.9 |
| KIDNE20084030 | 1.6 | 0.1 | 0.3 | 0.1 | 0.0 | 0.0 |
| KIDNE20084800 | 0.6 | 0.3 | 0.0 | 0.5 | 0.5 | 1.1 |
| KIDNE20134130 | 0.4 | 0.4 | 0.5 | 2.3 | 1.2 | 1.6 |
| KIDNE20182540 |  |  |  | 1.1 | 0.3 | 0.3 |
| KIDNE20186170 | 0.0 | 0.0 | 0.0 | 0.6 | 0.0 | 0.0 |
| KIDNE20188630 | 1.5 | 0.5 | 0.5 | 0.4 | 0.3 | 0.0 |
| LIVER20007750 | 1.3 | 1.8 | 0.3 | 1.9 | 0.7 | 0.0 |
| MESAN20021220 | 1.7 | 2.6 | 1.6 | 2.3 | 0.9 | 0.3 |
| MESAN20084150 | 0.8 | 2.6 | 2.2 | 1.7 | 2.1 | 1.1 |
| NT2NE20059210 |  |  |  | 1.4 | 0.4 | 0.1 |
| NT2NE20082130 | 1.8 | 1.3 | 0.5 | 1.9 | 0.3 | 0.3 |
| NT2NE20092950 | 1.3 | 2.7 | 3.4 | 1.7 | 2.4 | 1.8 |
| NT2RP70031070 | 0.3 | 0.9 | 1.4 | 0.4 | 0.4 | 0.0 |
| OCBBF20012520 | 0.3 | 0.3 | 1.3 | 0.9 | 0.2 | 1.2 |
| OCBBF20110210 | 4.5 | 1.8 | 0.5 | 0.5 | 0.5 | 4.5 |
| OCBBF20110730 | 0.4 | 0.5 | 0.3 | 0.1 | 0.0 | 0.0 |
| OCBBF20155030 | 1.1 | 1.1 | 0.9 | 2.5 | 0.8 | 0.3 |
| OCBBF20165900 | 1.7 | 4.4 | 4.4 | 1.9 | 3.3 | 1.1 |
| OCBBF20170350 | 0.9 | 5.4 | 0.3 | 0.3 | 1.7 | 1.5 |
| OCBBF20176650 | 0.5 | 1.3 | 0.5 | 0.7 | 0.7 | 0.0 |
| PLACE60006300 | 0.8 | 3.2 | 1.0 | 0.5 | 0.5 | 0.9 |
| PLACE60061370 | 2.7 | 0.8 | 1.5 | 1.2 | 1.0 | 1.3 |
| PROST20011160 | 0.2 | 1.7 | 2.0 | 1.3 | 5.5 | 1.7 |
| PROST20041460 | 2.9 | 0.1 | 1.5 | 0.6 | 0.0 | 0.0 |
| PROST20065100 | 1.4 | 1.9 | 1.6 | 5.3 | 0.0 | 0.0 |
| PROST20075280 | 1.7 | 0.5 | 0.5 | 2.6 | 0.5 | 0.5 |
| PROST20106060 | 0.2 | 0.2 | 2.0 | 1.0 | 0.6 | 0.7 |
| PROST20110120 | 1.2 | 0.6 | 0.5 |  |  |  |
| SKMUS20091900 | 1.2 | 1.6 | 0.3 | 1.2 | 2.6 | 0.3 |
| SMINT20024140 |  |  |  | 0.0 | 0.1 | 0.0 |
| SMINT20092160 | 0.5 | 0.7 | 0.3 | 1.3 | 1.2 | 0.3 |
| SPLEN20040780 | 1.0 | 2.8 | 1.9 | 0.3 | 0.8 | 0.1 |
| SPLEN20110860 | 2.4 | 0.1 | 7.6 | 1.4 | 0.1 | 0.1 |
| SPLEN20177400 | 0.8 | 3.3 | 1.3 | 1.3 | 0.7 | 0.3 |
| TESTI20038240 |  |  |  | 0.1 | 0.0 | 0.0 |
| TESTI20043130 | 0.0 | 0.1 | 0.7 |  |  |  |
| TESTI20046540 | 1.1 | 0.8 | 0.2 | 1.1 | 0.8 | 0.3 |
| TESTI20047370 | 0.4 | 0.4 | 0.5 | 0.6 | 0.0 | 0.5 |
| TESTI20057200 | 2.5 | 0.0 | 1.2 | 1.1 | 0.4 | 0.3 |
| TESTI20057590 | 0.1 | 0.1 | 0.0 | 3.8 | 3.5 | 2.2 |
| TESTI20113940 | 5.2 | 0.2 | 0.2 | 4.4 | 0.4 | 0.4 |
| TESTI20149880 |  |  |  | 2.2 | 0.2 | 2.2 |
| TESTI20151800 | 2.1 | 3.3 | 2.3 | 2.5 | 1.0 | 0.3 |
| TESTI20173050 | 0.8 | 0.6 | 0.5 | 1.8 | 1.1 | 1.0 |
| TESTI20198600 |  |  |  | 2.2 | 0.2 | 2.2 |
| TESTI20257910 | 1.2 | 0.3 | 0.3 | 1.2 | 0.2 | 0.7 |
| TESTI20262940 | 1.5 | 1.1 | 0.2 | 1.1 | 1.3 | 0.2 |
| THYMU20046770 |  |  |  | 1.7 | 0.5 | 0.5 |
| THYMU20058550 |  |  |  | 1.9 | 0.1 | 0.1 |
| THYMU20062520 | 0.0 | 0.0 | 0.7 | 0.2 | 0.3 | 0.1 |
| THYMU20062770 |  |  |  | 1.6 | 1.0 | 0.3 |
| THYMU20078240 | 0.3 | 1.7 | 2.9 | 0.0 | 1.0 | 0.1 |
| THYMU20150190 | 0.2 | 0.2 | 0.6 | 1.4 | 0.5 | 1.9 |
| TRACH20125620 | 1.1 | 2.5 | 1.5 | 1.4 | 1.4 | 1.0 |
| TRACH20149740 | 9.4 | 9.4 | 0.9 | 1.6 | 2.1 | 0.6 |
| TRACH20190460 | 2.0 | 3.3 | 3.1 | 0.2 | 1.1 | 0.2 |
| UTERU20045200 | 1.4 | 2.6 | 3.9 | 0.9 | 2.1 | 2.5 |
| UTERU20064120 | 0.6 | 2.7 | 2.0 | 0.6 | 1.7 | 0.4 |
| UTERU20103200 | 0.1 | 0.0 | 0.9 | 2.4 | 1.7 | 0.9 |
| ADRGL20046760 |  |  |  | 0.5 | 0.5 | 0.5 |
| ASTRO20055530 | 0.7 | 2.4 | 1.7 | 0.8 | 2.1 | 1.6 |

-continued

| Clone name | THP-1 | | | MKN45 | | |
|---|---|---|---|---|---|---|
| | ct1 | TNF_1h | TNF_3h | ct1 | Hp | ΔcagE |
| BRAMY20076130 | 0.1 | 1.4 | 0.2 | 0.1 | 0.0 | 0.0 |
| CTONG20170940 | 1.6 | 0.8 | 0.3 | 0.5 | 9.9 | 0.5 |
| FCBBF20033360 | 0.1 | 0.4 | 1.4 | 6.4 | 0.3 | 0.7 |
| FCBBF30257370 | 2.7 | 0.3 | 0.3 | 2.2 | 0.1 | 2.2 |
| FCBBF50001650 | 1.0 | 1.6 | 1.2 | 1.3 | 1.0 | 0.9 |
| FEBRA20040290 | 0.4 | 1.9 | 1.1 | 0.4 | 1.5 | 1.4 |
| FEBRA20063720 | 2.9 | 3.3 | 3.1 | 1.5 | 0.7 | 1.4 |
| FEBRA20098040 | 2.5 | 2.1 | 1.5 | 4.2 | 0.0 | 0.3 |
| FEBRA20108580 | 1.4 | 2.8 | 2.8 | 0.7 | 0.2 | 0.2 |
| MESAN20021860 | 0.1 | 1.2 | 0.2 | 0.9 | 1.0 | 0.9 |
| MESAN20067430 | 0.8 | 3.0 | 1.5 | 0.0 | 0.3 | 0.0 |
| NT2NE20045190 | 0.7 | 0.2 | 0.2 | 0.8 | 0.6 | 0.2 |
| PROST20016760 | | | | 1.1 | 3.4 | 2.3 |
| SKNSH20007160 | 0.6 | 0.3 | 0.2 | 1.1 | 0.7 | 0.6 |
| SMINT20006020 | 2.5 | 1.0 | 0.3 | 2.4 | 0.3 | 0.3 |
| TESTI20059370 | 0.0 | 0.2 | 0.3 | 0.0 | 0.0 | 0.0 |
| TESTI20103690 | 0.0 | 0.0 | 0.0 | 0.8 | 0.3 | 0.3 |
| TESTI20254480 | 0.0 | 0.1 | 0.6 | 0.8 | 0.6 | 0.0 |
| THYMU10004280 | 0.2 | 2.2 | 0.2 | 0.2 | 1.1 | 1.4 |
| THYMU20030460 | 0.2 | 0.6 | 0.2 | 0.6 | 0.8 | 2.4 |
| TRACH20090060 | 0.5 | 0.3 | 2.0 | 0.0 | 6.8 | 1.7 |
| UTERU20041970 | 1.6 | 1.1 | 1.5 | 0.0 | 3.5 | 2.4 |
| BRAMY20125360 | 0.8 | 1.6 | 1.1 | 0.0 | 0.0 | 0.0 |
| OCBBF20142290 | 0.2 | 0.9 | 0.3 | 0.1 | 0.4 | 0.0 |
| SKMUS20006790 | 0.7 | 0.5 | 0.3 | 1.0 | 0.8 | 0.7 |
| TESTI20030610 | 0.1 | 2.0 | 1.7 | 0.0 | 0.3 | 0.0 |
| UTERU20026620 | 0.4 | 4.2 | 4.2 | 2.4 | 2.7 | 0.9 |

Homology Search Result Data

Data obtained by the homology search for full-length nucleotide sequences and deduced amino acid sequences.

In the result of the search shown below, both units, aa and bp, are used as length units for the sequences to be compared.

Each data includes Clone name, Definition in hit data, P value, Length of sequence to be compared, Homology, and Accession number (No.) of hit data. These items are shown in this order and separated by a double-slash mark, //.

ADRGL20020290//Human placental equilibrative nucleoside transporter 1 (hENT1) mRNA, complete cds.//1.70E−240//456aa//100%//U81375
ADRGL20021910//Homo sapiens transmembrane protein B7-H2 ICOS ligand mRNA, complete cds.//2.50E−88//168aa//100%//AAG01176
ADRGL20022600//DIAPHANOUS PROTEIN HOMOLOG 1 (P140MDIA).//2.00E−07//121aa//36%//008808
ADRGL20023920//ABC1 PROTEIN HOMOLOG PRECURSOR.//1.40E−98//467aa//45%//Q92338
ADRGL20026790//Homo sapiens PLIC-1 mRNA, complete cds.//6.10E−05//169aa//31%//AF293384
ADRGL20027530
ADRGL20036380
ADRGL20036840//HLA CLASS I HISTOCOMPATIBILITY ANTIGEN, ALPHA CHAIN H PRECURSOR (HLA-AR) (HLA-12.4).//7.30E−68//131aa//96%//P01893
ADRGL20040310
ADRGL20040770
ADRGL20046760
ADRGL20047080
ADRGL20047770
ADRGL20057560
ADRGL20059610//GLUCOSYLCERAMIDASE PRECURSOR (EC 3.2.1.45) (BETA-GLUCOCEREBROSIDASE) (ACID BETA-GLUCOSIDASE) (D-GLUCOSYL-N-ACYLSPHINGOSINE GLUCOHYDROLASE) (ALGLUCERASE) (IMIGLUCERASE).//3.00E−94//188aa//93%//P04062
ADRGL20062330//Homo sapiens trabeculin-alpha mRNA, complete cds.//1.10E−128//439aa//58%//AF141968
ADRGL20063770
ADRGL20066770//elastin microfibril interface located protein [Homo sapiens].//3.00E−31//210aa//44%//NP_008977
ADRGL20067320
ADRGL20079060//Mus musculus mRNA for Ky protein (muscle-specific protein).//3.80E−266//281aa//84%//AJ293727
ADRGL20095330
ASTRO20001910//Rattus norvegicus mRNA for annexin V-binding protein (ABP-10), partial cds.//2.20E−57//153aa//73%//D64062
ASTRO20003720
ASTRO20004820
ASTRO20006530//Homo sapiens hook1 protein (HOOK1) mRNA, complete cds.//1.80E−94//383aa//55%//AF044923
ASTRO20009140//PUTATIVE COMPETENCE-DAMAGE PROTEIN.//2.70E−06//167aa//29%//P46323
ASTRO20010010
ASTRO20010290
ASTRO20012270
ASTRO20020240
ASTRO20020350
ASTRO20022020
ASTRO20026320//NAM7 PROTEIN (NONSENSE-MEDIATED mRNA DECAY PROTEIN 1) (UP-FRAMESHIFT SUPPRESSOR 1).//1.80E−47//432aa//33%//P30771
ASTRO20027330
ASTRO20038400//Homo sapiens zinc finger homeobox protein ZHX1 mRNA, complete cds.//3.40E−78//282aa//42%//AF106862
ASTRO20045840
ASTRO20046280//PSU1 PROTEIN.//1.30E−42//228aa//36%//P53550
ASTRO20047510
ASTRO20050810//L-RIBULOKINASE (EC 2.7.1.16).//i.1.10E−43//512aa//30%//P94524
ASTRO20052420//PROBABLE GUANINE NUCLEOTIDE REGULATORY PROTEIN TIM (ONCOGENE TIM) (P60 TIM) (TRANSFORMING IMMORTALIZED MAMMARY ONCOGENE).//4.80E−151//408aa//76%//Q12774
ASTRO20053430//BAND 4.1-LIKE PROTEIN 4 (NBL4 PROTEIN).//1.80E−58//307aa//38%//057457
ASTRO20055530
ASTRO20055570//MAJOR PRION PROTEIN PRECURSOR (PRP) (PRP27-30) (PRP33-35C) (ASCR).//5.40E−72//137aa//100%//P04156
ASTRO20055930
ASTRO20058960//DNA damage inducible protein homolog—fission yeast (Schizosaccharomyces pombe)//1.90E−14//205aa//31%//T39541
ASTRO20069200
ASTRO20075150//TNF RECEPTOR ASSOCIATED FACTOR 3 (CD40 RECEPTOR ASSOCIATED FACTOR 1) (CRAF1) (CD40 BINDING PROTEIN) (CD40BP) (LMP1 ASSOCIATED PROTEIN) (LAP1).//1.00E−25//60aa//98%//Q13114

ASTRO20076660
ASTRO20085080//TIPD PROTEIN.//1.80E-58//307aa//37%//015736
ASTRO20088950//LACTASE-PHLORIZIN HYDROLASE PRECURSOR (LACTASE-GLYCOSYLCERAMIDASE) [INCLUDES: LACTASE (EC 3.2.1.108); PHLORIZIN HYDROLASE (EC 3.2.1.62)].//7.80E-85//331aa//48%//P09848
ASTRO20089600//*Mus musculus* sacsin gene, complete cds.//1.10E-05//198aa//26%//AF193557
ASTRO20090680//*M.musculus* mRNA for IB3/5-polypeptide.//1.60E-173//412aa//78%//X79131
ASTRO20091180
ASTRO20091770
ASTRO20141740
BGGI120000670//*Rattus norvegicus* myosin heavy chain Myr 8b mRNA, complete cds.//1.60E-05//86aa//36%//AY004215
BGGI120010750//*Rattus norvegicus* mRNA for SECIS binding protein 2 (sbp2 gene).//7.90E-305//812aa//71%//AJ251245
BNGH410000570
BNGH420008150//Human SH3 domain-containing proline-rich kinase (sprk) mRNA, complete cds.//3.40E-139//326aa//82%//U07747
BNGH420014060
BNGH420015760//*Mus musculus* mRNA for JNK-binding protein JNKBP1, complete cds.//1.60E-130//381aa//60%//AB029482
BNGH420021680
BNGH420023870//RIBONUCLEASE INHIBITOR.//4.70E-41//314aa//34%//P10775
BNGH420024870
BNGH420035290//MYOSIN HEAVY CHAIN KINASE B (EC 2.7.1.129) (MHCK B).//7.60E-37//273aa//35%//P90648
BNGH420036410
BNGH420040760
BNGH420042910
BNGH420045380
BNGH420046790//immunoglobulin lambda light chain variable region [*Homo sapiens*].//5.00E-47//84aa//100%//AAG24674
BNGH420052350
BNGH420059680//DIPZ PROTEIN.//3.00E-13//166aa//31%//Q10801
BNGH420061350
BNGH420062340
BNGH420070370//ZINC FINGER PROTEIN GLI1 (GLI).//3.20E-65//165aa//59%//P47806
BNGH420074600//DNA-DIRECTED RNA POLYMERASE III 128 KDA POLYPEPTIDE (EC 2.7.7.6) (RNA POLYMERASE III SUBUNIT 2).//5.40E-214//522aa//72%//P25167
BNGH420075940
BNGH420077980//*Rattus norvegicus* ankyrin binding cell adhesion molecule neurofascin mRNA, alternatively spliced form, partial cds.//0//588aa//98%//U81036
BNGH420085100
BNGH420086030//N-CHIMAERIN (NC) (N-CHIMERIN) (ALPHA CHIMERIN) (A-CHIMAERIN).//2.30E-21//130aa//40%//P15882
BNGH420087430//*Mus musculus* mRNA 1 for phtf protein.//5.80E-118//237aa//57%//AJ133721
BRACE10000510//KERATIN, ULTRA HIGH-SULFUR MATRIX PROTEIN (UHS KERATIN).//4.70E-12//132aa//37%//P26371
BRACE20003310//ZINC FINGER PROTEIN 85 (ZINC FINGER PROTEIN HPF4) (HTF1).//1.00E-205//504aa//71%//Q03923
BRACE20007330//RING CANAL PROTEIN (KELCH PROTEIN).//4.60E-66//562aa//31%//Q04652
BRACE20009050
BRACE20014450//*Mus musculus* mRNA for Ndr1 related protein Ndr2, complete cds.//3.20E-150//291aa//95%//AB033921
BRACE20017790
BRACE20018810
BRACE20025820
BRACE20038920
BRACE20050870//PRE-MRNA SPLICING HELICASE BRR2 (EC 3.6.1.-).//8.40E-59//584aa//31%//P32639
BRACE20051600
BRACE20051930//NEUROPILIN PRECURSOR (A5 PROTEIN) (A5 ANTIGEN).//5.50E-20//179aa//30%//P28824
BRACE20052430//*Homo sapiens* AMSH mRNA, complete cds.//4.30E-75//272aa//53%//U73522
BRACE20052530
BRACE20054080
BRACE20054480
BRACE20054600//*Xenopus laevis* mRNA for Kielin, complete cds.//4.30E-70//205aa//60%//AB026192
BRACE20055560
BRACE20057870
BRACE20059110
BRACE20059810
BRACE20061620//ZINC-BINDING PROTEIN A33.//3.60E-30//329aa//28%//Q02084
BRACE20062580
BRACE20063540//MEROZOITE SURFACE PROTEIN CMZ-8 (FRAGMENT).//1.60E-10//164aa//35%//P09125
BRACE20065470//*Xenopus laevis* ubiquitin-like fusion protein mRNA, complete cds.//6.70E-63//170aa//71%//L08474
BRACE20066360
BRACE20068710
BRACE20069000//CLN3 PROTEIN (BATTENIN) (BATTEN'S DISEASE PROTEIN).//1.20E-147//279aa//100%//Q13286
BRACE20069110
BRACE20069440
BRACE20079200//*Xenopus laevis* mRNA for Kielin, complete cds.//3.10E-15//63aa//58%//AB026192
BRACE20079370//microtubule associated-protein orbit [*Drosophila melanogaster*].//8.00E-42//282aa//36%//BAA94248
BRACE20097540//*Homo sapiens* protein serine/threonine phosphatase 4 regulatory subunit 1 (PP4R1) mRNA, complete cds.//2.80E-96//193aa//96%//AF111106
BRACE20098860
BRACE20099070
BRACE20194670//UDP-GALACTOSE TRANSLOCATOR (UDP-GALACTOSE TRANSPORTER) (UGT) (UDP-GAL-TR).//1.40E-32//72aa//98%//P78381
BRACE20196180//*Homo sapiens* HMG domain protein HMGX2 (HMGX2) mRNA, complete cds.//6.90E-154//235aa//91%//AF146223
BRACE20196960
BRACE20200770//PROTEIN MOV-10.//3.30E-24//113aa//50%//P23249
BRACE20200970
BRACE20204670//PROTEIN-TYROSINE PHOSPHATASE ALPHA PRECURSOR (EC 3.1.3.48) (R-PTP-ALPHA).//4.30E-237//428aa//99%//P18433

BRACE20205840
BRACE20207420
BRACE20212450
BRACE20215410//PROTEIN-TYROSINE PHOSPHATASE YVH1 (EC 3.1.3.48) (PTPASE YVH1).//2.90E−08//136aa//31%//Q02256
BRACE20216700
BRACE20216950//4F2 CELL-SURFACE ANTIGEN HEAVY CHAIN (4F2HC) (LYMPHOCYTE ACTIVATION ANTIGEN 4F2 LARGE SUBUNIT) (4F2 HEAVY CHAIN ANTIGEN) (CD98 ANTIGEN).//4.80E−66//94aa//90%//P08195
BRACE20219360
BRAMY10000980
BRAMY10001730
BRAMY20000210
BRAMY20000250
BRAMY20001510//*Homo sapiens* RING zinc finger protein (RZF) mRNA, complete cds.//3.80E−131//245aa//99%//AF037204
BRAMY20003540//1-PHOSPHATIDYLINOSITOL-4,5-BISPHOSPHATE PHOSPHODIESTERASE DELTA 1 (EC 3.1.4.11) (PLC-DELTA-1) (PHOSPHOLIPASE C-DELTA-1) (PLC-III).//0//745aa//99%//P51178
BRAMY20003880
BRAMY20005080//UBIQUITIN CARBOXYL-TERMINAL HYDROLASE 16 (EC 3.1.2.15) (UBIQUITIN THIOLESTERASE 16) (UBIQUITIN-SPECIFIC PROCESSING PROTEASE 16) (DEUBIQUITINATING ENZYME 16) (UBIQUITIN PROCESSING PROTEASE UBP-M).//2.70E−46//93aa//100%//Q9Y5T5
BRAMY20013670//PECANEX PROTEIN.//1.80E−84//300aa//56%//P18490
BRAMY20016780
BRAMY20020440
BRAMY20021580
BRAMY20023390
BRAMY20023640
BRAMY20024790
BRAMY20027390
BRAMY20027990//*Homo sapiens* NEDL1 mRNA for NEDD4-like ubiquitin ligase 1, complete cds.//4.60E−158//294aa//100%//AB048365
BRAMY20028530
BRAMY20028620//NICOTINATE-NUCLEOTIDE PYROPHOSPHORYLASE [CARBOXYLATING] (EC 2.4.2.19) (QUINOLINATE PHOSPHORIBOSYL-TRANSFERASE [DECARBOXYLATING]) (QAPRTASE).//9.70E−18//53aa//84%//Q15274
BRAMY20035380//ZINC TRANSPORTER 1 (ZNT-1).//5.60E−40//211aa//35%//Q62720
BRAMY20035830//*Homo sapiens* RCC1-like G exchanging factor RLG mRNA, complete cds.//3.60E−103//251aa//75%//AF060219
BRAMY20036530
BRAMY20036810
BRAMY20038980//INTRACELLULAR PROTEIN TRANSPORT PROTEIN US01.//3.40E−17//407aa//23%//P25386
BRAMY20039290
BRAMY20040580//ZINC FINGER PROTEIN 135.//1.70E−29//115aa//54%//P52742
BRAMY20043520
BRAMY20043630//*Homo sapiens* Ras-binding protein SUR-8 mRNA, complete cds.//1.30E−167//364aa//88%//AF068920
BRAMY20044920//UBIQUITIN CARBOXYL-TERMINAL HYDROLASE 4 (EC 3.1.2.15) (UBIQUITIN THIOLESTERASE 4) (UBIQUITIN-SPECIFIC PROCESSING PROTEASE 4) (DEUBIQUITINATING ENZYME 4) (UBIQUITOUS NUCLEAR PROTEIN HOMOLOG).//7.60E−28//86aa//47%//Q13107
BRAMY20045210
BRAMY20045420
BRAMY20047560
BRAMY20050640
BRAMY20005940
BRAMY20051820//Human mRNA for Doc2 (Double C2), complete cds.//1.90E−49//102aa//99%//D31897
BRAMY20052440
BRAMY20053910
BRAMY20055760//POTENTIAL PHOSPHOLIPID-TRANSPORTING ATPASE VA (EC 3.6.1.-).//5.80E−130//393aa//59%//054827
BRAMY20056620//*Homo sapiens* mccb mRNA for non-biotin containing subunit of 3-methylcrotonyl-CoA carboxylase, complete cds.//3.00E−106//203aa//100%//AB050049
BRAMY20056840//UBE-1c2//2.40E−74//261aa//53%//AB030505
BRAMY20063750//*Homo sapiens* HRIHFB2007 mRNA, partial cds.//3.40E−139//253aa//99%//AB015330
BRAMY20072440
BRAMY20072870//ACETYL-COENZYME A SYNTHETASE (EC 6.2.1.1) (ACETATE-COA LIGASE) (ACYL-ACTIVATING ENZYME).//2.50E−15//88aa//46%//P16929
BRAMY20073080
BRAMY20074110
BRAMY20074860
BRAMY20076100//STEROIDOGENIC FACTOR 1 (STF-1) (SF-1) (STEROID HORMONE RECEPTOR AD4BP) (FUSHI TARAZU FACTOR HOMOLOG 1).//4.80E−66//1 32aa//94%//P50569
BRAMY20076130
BRAMY20076530
BRAMY20083330//SYNAPSIN I.//4.50E−05//155aa//29%//P17599
BRAMY20083820
BRAMY20089770//P2X PURINOCEPTOR 7 (ATP RECEPTOR) (P2X7) (PURINERGIC RECEPTOR) (P2Z RECEPTOR).//3.30E−136//242aa//99%//Q99572
BRAMY20091230//MITOCHONDRIAL UNCOUPLING PROTEIN 4 (UCP 4).//4.60E−121//224aa//100%//095847
BRAMY20093490//*Mus musculus* ubiquitin-protein ligase E3-alpha (Ubr1) mRNA, complete cds.//7.80E−43//139aa//55%//AF061555
BRAMY20094890//A KINASE ANCHOR PROTEIN 4 PRECURSOR (MAJOR FIBROUS SHEATH PROTEIN) (FSC1) (P82).//4.60E−06//131aa//27%//Q60662
BRAMY20095080
BRAMY20095570
BRAMY20096930//*Torpedo marmorata* mRNA for male sterility protein 2-like protein (ms21 gene).//2.00E−63//139aa//82%//AJ272073
BRAMY20100680
BRAMY20102900//*Homo sapiens* RU1 (RU1) mRNA, complete cds.//1.20E−47//151aa//58%//AF168132

BRAMY20107980
BRAMY20111780//ZINC FINGER PROTEIN 135.//1.00E-139//416aa//57%//P52742
BRAMY20117670//*Mus musculus* mmDNAJA4 mRNA for mmDj4, complete cds.//3.20E-118//239aa//90%//AB032401
BRAMY20118410
BRAMY20118490//GLYCEROL KINASE 2 (EC 2.7.1.30) (ATP:GLYCEROL 3-PHOSPHOTRANSFERASE 2) (GLYCEROKINASE 2) (GK 2).//1.80E-48//247aa//40%//Q9X1E4
BRAMY20120170
BRAMY20123400
BRAMY2 124970
BRAMY20125170
BRAMY20125360//L-ASPARAGINASE (EC 3.5.1.1) (L-ASPARAGINE AMIDOHYDROLASE).//3.30E-53//148aa//43%//Q9ZSD6
BRAMY20125550//*Homo sapiens* mRNA for 28 kD interferon responsive protein (IFRG28 gene).//4.40E-16//155aa//33%//AJ251832
BRAMY20126910
BRAMY20127310
BRAMY20127760
BRAMY20134050//NUCLEOSOME ASSEMBLY PROTEIN 1-LIKE 2 (BRAIN-SPECIFIC PROTEIN, X-LINKED).//1.40E-25//109aa//56%//P51860
BRAMY20135720
BRAMY20137360//*Homo sapiens* gene for TU12B1-TY, exon 12 and complete cds.//2.10E-18//257aa//31%//AB032786
BRAMY20139440
BRAMY20139750
BRAMY20143870//PEPTIDYL-TRNA HYDROLASE (EC 3.1.1.29) (PTH).//5.80E-27//182aa//35%//P96386
BRAMY20152510//PROTEIN-TYROSINE PHOSPHATASE STRIATUM-ENRICHED (EC 3.1.3.48) (STEP) (NEURAL-SPECIFIC PROTEIN-TYROSINE PHOSPHATASE) (FRAGMENT).//4.80E-293//537aa//97%//P54829
BRAMY20155500
BRAMY20158550//CALMODULIN.//1.60E-15//116aa//42%//P04352
BRAMY20159250
BRAMY20160020
BRAMY20173480
BRAMY20190550//EPIDERMAL GROWTH FACTOR RECEPTOR SUBSTRATE SUBSTRATE 15 (PROTEIN EPS15) (AF-1P PROTEIN).//2.20E-226//464aa//89%//P42566
BRAMY20194680
BRAMY20204270
BRAMY20206340//GUANINE NUCLEOTIDE-BINDING PROTEIN BETA SUBUNIT-LIKE PROTEIN.//4.20E-07//151aa//27%//P38011
BRAMY20219620
BRAMY20221600//*H.sapiens* mRNA for novel T-cell activation protein.//1.60E-130//245aa//99%//X94232
BRAMY20223010//*Mus musculus* leucine-rich glioma-inactivated 1 protein precursor, (Lgi1) mRNA, complete cds.//2.00E-79//269aa//52%//AF246818
BRAMY20225250
BRAMY20225320
BRAMY20227230
BRAMY20227860//*Homo sapiens* dickkopf-3 (DKK-3) mRNA, complete cds.//2.30E-69//147aa//92%//AF177396
BRAMY20227960
BRAMY20231150//PUTATIVE ACID PHOSPHATASE F26C11.1 (EC 3.1.3.2).//2.30E-55//322aa//39%//Q09549
BRAMY20234820//*Homo sapiens* mitotic checkpoint protein (MAD1) mRNA, complete cds.//1.30E-286//561aa//100%//AF123318
BRAMY20237190
BRAMY20238630//TETRATRICOPEPTIDE REPEAT PROTEIN 4.//1.20E-147//276aa//99%//O95801
BRAMY20243120
BRAMY20244490//ADENYLATE KINASE ISOENZYME 1 (EC 2.7.4.3) (ATP-AMP TRANSPHOSPHORYLASE) (AK1) (MYOKINASE).//2.50E-19//119aa//37%//P00571
BRAMY20245140//*Rattus norvegicus* potassium channel (erg2) mRNA, complete cds.//1.00E-178//427aa//81%//AF016192
BRAMY20245350
BRAMY20245760//*Araneus diadematus* fibroin-4 mRNA, partial cds.//7.90E-05//285aa//22%//U47856
BRAMY20251210//EPHRIN TYPE-A RECEPTOR 7 PRECURSOR (EC 2.7.1.112) (TYROSINE-PROTEIN KINASE RECEPTOR EHK-3) (EPH HOMOLOGY KINASE-3) (EMBRYONIC BRAIN KINASE) (EBK) (DEVELOPMENTAL KINASE 1) (MDK-1). //3.80E-94//268aa//66%//Q61772
BRAMY20251750//*Homo sapiens* BRI3 mRNA, complete cds.//2.80E-131//242aa//95%//AF272043
BRAMY20263000//DYSTROPHIA MYOTONICA-CONTAINING WD REPEAT MOTIF PROTEIN (DMR-N9 PROTEIN).//2.60E-134//430aa//59%//Q08274
BRAMY20267780
BRAMY20269040
BRAMY20271140
BRAMY20274510//60S RIBOSOMAL PROTEIN L12.//1.10E-39//102aa//82%//P30050
BRAMY20285650
BRAMY20287400
BRAWH20014590//ZAKI-4 PROTEIN.//3.10E-92//187aa//93%//Q14206
BRAWH20020470
BRAWH20020600
BRAWH20021910//FATTY ACYL-COA HYDROLASE PRECURSOR, MEDIUM CHAIN (EC 3.1.2.14) (THIOESTERASE B).//1.30E-111//450aa//49%//Q04791

BRAWH20025490
BRAWH20026010//AD021 protein [*Homo sapiens*]//4.00E-55//245aa//44%//NP_057697
BRAWH20027250
BRAWH20030000
BRAWH20039640//SLIT PROTEIN PRECURSOR.//6.10E-19//282aa//31%//P24014
BRAWH20040680//PUTATIVE TRANSCRIPTION ELONGATION FACTOR S-II (TFIIS).//5.90E-06//179aa//29%//P52652
BRAWH20047790
BRAWH20050740//ZINC FINGER PROTEIN 151 (POLYOMAVIRUS LATE INITIATOR PROMOTER BINDING PROTEIN) (LP-1) (ZINC FINGER PROTEIN Z13).//1.60E-16//235aa//30%//Q60821
BRAWH20055240
BRAWH20055330
BRAWH20055780
BRAWH20058120
BRAWH20063010//SPLICEOSOME ASSOCIATED PROTEIN 49 (SAP 49) (SF3B53).//2.60E-06//121aa//33%//Q15427
BRAWH20078080
BRAWH20078620
BRAWH20080580//ZINC FINGER PROTEIN 84 (ZINC FINGER PROTEIN HPF2).//1.00E-116//316aa//63%//P51523
BRAWH20082550
BRAWH20082920//Human TFIIIC Box B-binding subunit mRNA, complete cds.//1.90E-36//72aa//100%//U02619
BRAWH20093040//PROTEIN KINASE CLK2 (EC 2.7.1.-).//2.70E-86//162aa//96%//P49760
BRAWH20093070//SYNAPSIN.//4.80E-06//245aa//28%//Q24546
BRAWH20094900//*Mus musculus* mRNA for sialidase, complete cds.//5.70E-73//310aa//50%//AB026842
BRAWH20095900//ZINC FINGER PROTEIN 184 (FRAGMENT).//1.20E-170//631aa//48%//Q99676
BRAWH20173790
BRAWH20174330//SPLICEOSOME ASSOCIATED PROTEIN 49 (SAP 49) (SF3B53).//4.50E-06//121aa//33%//Q15427
BRAWH20175230
BRAWH20175340
BRAWH20176850//*Mus musculus* mRNA for nuclear protein ZAP, complete cds.//9.50E-151//619aa//53%//AB033168
BRAWH20182670
BRAWH20183170//GRR1 PROTEIN.//9.30E-13//218aa//28%//P24814
BRAWH20185260
BRAWH20185270
BRAWH20186010
BRAWH20188750//BIOTIN SYNTHESIS PROTEIN BIOC.//5.80E-11//190aa//27%//P36571
BRAWH20190530//*Homo sapiens* BNPI mRNA for brain-specific Na-dependent inorganic phosphate cotransporter, complete cds.//2.10E-109//118aa//100%//AB032436
BRAWH20190550//PUTATIVE SERINE/THREONINE-PROTEIN KINASE PKWA (EC 2.7.1.-).//1.30E-05//172aa//29%//P49695
BRAWH20191980//PROLINE OXIDASE, MITOCHONDRIAL PRECURSOR (EC 1.5.3.-) (PROLINE DEHYDROGENASE).//2.10E-125//234aa//99%//O43272
BRCAN10000760//UREA TRANSPORTER, ERYTHROCYTE.//1.30E-212//389aa//100%//Q13336
BRCAN10001050//PEANUT-LIKE PROTEIN 2 (BRAIN PROTEIN H5).//1.40E-62//122aa//98%//O43236
BRCAN10001680
BRCAN20001480
BRCAN20004180//alpha-1C-adrenergic receptor splice form 2—human//1.10E-22//76aa//76%//S65657
BRCAN20005230//HEPARIN SULFATE N-DEACETYLASE/N-SULFOTRANSFERASE (EC 2.8.2.-) (N-HSST) (N-HEPARIN SULFATE SULFOTRANSFERASE) (GLUCOSAMINYL N-DEACETYLASE/N-SULFOTRANSFERASE).//8.90E-15//168aa//28%//P52849
BRCAN20005410//Human 1(3)mbt protein homolog mRNA, complete cds.//2.00E-95//378aa//50%//U89358
BRCOC10000400
BRCOC20000470//*Homo sapiens* DEME-6 mRNA, partial cds.//7.30E-37//252aa//28%//AF007170
BRCOC20003600//VACUOLAR ATP SYNTHASE SUBUNIT AC45 PRECURSOR (EC 3.6.1.34) (V-ATPASE AC45 SUBUNIT).//5.90E-192//418aa//85%//P40682
BRHIP10000720
BRHIP10001040//tweety homolog 1 (Drosophila) [*Mus musculus*]//1.30E-68//311aa//44%//NP_067299
BRHIP20000210
BRHIP20003590
BRHIP20005060
BRSSN20001970
BRSSN20005610//*Mus musculus* semaphorin cytoplasmic domain—associated protein 3A (Semcap3) mRNA, complete cds.//6.30E-225//730aa//60%//AF127084
BRSSN20005660
BRSSN20066440//ZINC FINGER PROTEIN 202.//3.60E-37//169aa//37%//O95125
BRSSN20074640//HYPOTHETICAL 35.8 KDA PROTEIN IN PRP16-SRP40 INTERGENIC REGION.//4.50E-20//217aa//28%//P36163
BRSSN20091190
BRSSN20092440
BRSSN20093890//*Homo sapiens* mRNA for Kelch motif containing protein, complete cds.//8.40E-13//203aa//30%//AB026190
CD34C20001750//MHC CLASS I NK CELL RECEPTOR PRECURSOR (NATURAL KILLER ASSOCIATED TRANSCRIPT 4) (NKAT-4).//1.10E-18//214aa//35%//P43630
CTONG10000090
CTONG20000340
CTONG20002790
CTONG20004110//*Mus musculus* ankycorbin mRNA, complete cds.//6.20E-55//1006aa//24%//AF202315
CTONG20004520//development- and differentiation-enhancing factor 2; PYK2 C terminus-associated protein [*Homo sapiens*].//2.00E-86//310aa//81%//NP_003878
CTONG20007660//*Rattus norvegicus* caspase recruitment domain protein 9 mRNA, complete cds.//7.30E-28//319aa//32%//AF311288
CTONG20008190//YPT1-RELATED PROTEIN 2.//3.00E-30//160aa//40%//P17609
CTONG20008460
CTONG20015240
CTONG20017490//SEMAPHORIN 4A PRECURSOR (SEMAPHORIN B) (SEMA B).//3.10E-273//607aa//82%//Q62178
CTONG20020660
CTONG20020950//ZINC FINGER PROTEIN 37 (ZFP-37) (MALE GERM CELL SPECIFIC ZINC FINGER PROTEIN).//7.40E-23//258aa//25%//P17141

CTONG20027660
CTONG20029030//*Homo sapiens* Ras-binding protein SUR-8 mRNA, complete cds.//8.30E−25//402aa//28%//AF068920
CTONG20030280//VEGETATIBLE INCOMPATIBILITY PROTEIN HET-E-1.//2.90E−12//303aa//25%//Q00808
CTONG20031150
CTONG20031890
CTONG20032930//microtubule associated-protein orbit [*Drosophila melanogaster*]//1.00E−79//913aa//30%//BAA94248
CTONG20033500
CTONG20033610//*Rattus norvegicus* SNIP-a mRNA, complete cds.//2.50E−145//567aa//41%//AF156981
CTONG20033750//*Drosophila melanogaster* AAA family protein Bor (bor) mRNA, complete cds.//1.40E−174//492aa//66%//AF227209
CTONG20035240
CTONG20036800
CTONG20036990//BASEMENT MEMBRANE-SPECIFIC HEPARAN SULFATE PROTEOGLYCAN CORE PROTEIN PRECURSOR (HSPG) (PERLECAN) (PLC).//1.10E−10//247aa//27%//Q05793
CTONG20039370
CTONG20041150//*Streptomyces ansochromogenes* strain 7100 SanE (sanE) gene, complete cds.//5.20E−05//133aa//35%//AF228524
CTONG20041260//*Mus musculus* retinoic acid-responsive protein (Stra6) mRNA, complete cds.//1.30E−238//602aa//74%//AF062476
CTONG20042640//NEUROBLAST DIFFERENTIATION ASSOCIATED PROTEIN AHNAK (DESMOYOKIN) (FRAGMENTS).//0//797aa//73%//Q09666
CTONG20044230//*Mus musculus* zinc finger protein (Mtsh1) mRNA, partial cds.//1.40E−289//601aa//89%//AF191309
CTONG20044870
CTONG20045500//ANION EXCHANGE PROTEIN 3 (CARDIAC/BRAIN BAND 3-LIKE PROTEIN) (CAE3/BAE3).//2.00E−19//276aa//30%//P48751
CTONG20046690
CTONG20049480
CTONG20050490
CTONG20051100//PUTATIVE METHYLTRANSFERASE (EC 2.1.1.-).//3.50E−29//72aa//87%//O43709
CTONG20051450//testis development protein PRTD [*Homo sapiens*].//9.00E−50//140aa//85%//AAG33852
CTONG20052780//*Homo sapiens* mRNA for SH3 binding protein, complete cds.//8.00E−21//125aa//42%//AB005047
CTONG20053990//ZINC FINGER PROTEIN 195.//4.30E−08//40aa//75%//O14628
CTONG20055670
CTONG20055850//*Rattus norvegicus* golgi peripheral membrane protein p65 (GRASP65) mRNA, complete cds.//1.10E−99//248aa//78%//AF015264
CTONG20056150
CTONG20057750
CTONG20057950
CTONG20059130//*Mus musculus* prominin-like protein mRNA, partial cds.//7.50E−103//259aa//77%//AF128113
CTONG20060040
CTONG20061290
CTONG20062730
CTONG20063770//M-PHASE PHOSPHOPROTEIN 9 (FRAGMENT).//1.80E−96//184aa//100%//Q99550
CTONG20063930//BETA-CHIMAERIN (BETA-CHIMERIN).//3.50E−31//189aa//34%//Q03070
CTONG20065240
CTONG20065680
CTONG20066110//*Homo sapiens* DEME-6 mRNA, partial cds.//8.70E−164//557aa//53%//AF007170
CTONG20068360//MITOCHONDRIAL CARNITINE/ACYLCARNITINE CARRIER PROTEIN (CARNITINE/ACYLCARNITINE TRANSLOCASE) (CAC).//8.00E−30//248aa//35%//P97521
CTONG20069320
CTONG20069420
CTONG20070090
CTONG20070720//N-CHIMAERIN (NC) (N-CHIMERIN) (ALPHA CHIMERIN) (A-CHIMAERIN).//9.20E−25//180aa//33%//P30337
CTONG20070780//SPERM-SPECIFIC ANTIGEN 2 (CLEAVAGE SIGNAL-1 PROTEIN) (CS-1).//1.90E−122//249aa//97%//P28290
CTONG20070910//*Homo sapiens* mRNA for 26S proteasome subunit p55, complete cds.//7.70E−227//400aa//100%//AB003103
CTONG20071040//BETA CRYSTALLIN B2 (BP).//6.80E−25//195aa//34%//P26775
CTONG20071680//HYPOTHETICAL 33.6 KDA PROTEIN IN TDK-PRFA INTERGENIC REGION.//7.40E−14//328aa//23%//P45869
CTONG20072930//ZINC FINGER PROTEIN 41 (FRAGMENT).//4.10E−216//542aa//69%//P51814
CTONG20073990
CTONG20074000//*Mus musculus* teashirt 2 (Tsh2) gene, partial cds.//0//1024aa//89%//AF207880
CTONG20074170
CTONG20074740
CTONG20076230
CTONG20076810//site-1 protease of sterol regulatory element binding proteins [*Cricetulus griseus*]//2.80E−245//463aa//93%//AF078105
CTONG20077760//SYNAPSIN I.//1.70E−08//209aa//32%//P17599
CTONG20078340//SUPPRESSOR PROTEIN SRP40.//4.10E−08//282aa//26%//P32583
CTONG20079590//ALPHA-N-ACETYLGALACTOSAMINIDE ALPHA-2,6-SIALYLTRANSFERASE (EC 2.4.99.-) (ST6GALNACIII) (STY).//1.80E−151//305aa//85%//Q64686
CTONG20080140//HYPOTHETICAL 60.3 KDA PROTEIN R13G10.2 IN CHROMOSOME III.//8.40E−29//179aa//40%//Q21988
CTONG20081840
CTONG20083430
CTONG20083980//VASODILATOR-STIMULATED PHOSPHOPROTEIN (VASP).//4.50E−10//113aa//34%//P50552
CTONG20084020
CTONG20084660//ZINC FINGER PROTEIN 165.//3.30E−33//142aa//57%//P49910
CTONG20085210//MONO- AND DIACYLGLYCEROL LIPASE PRECURSOR (EC 3.1.1.-) (MDGL).//3.60E−06//94aa//34%//P25234
CTONG20133720
CTONG20165590
CTONG20165750//SON PROTEIN (SON3).//4.40E−239//427aa//99%//P18583
CTONG20166580
CTONG20167750
CTONG20168240
CTONG20168460

CTONG20169040//KERATIN, TYPE I CYTOSKELETAL 15 (CYTOKERATIN 15) (K15) (CK 15).//6.00E−112//223aa//99%//P19012
CTONG20169530
CTONG20170940//MYOTROPHIN (V-1 PROTEIN) (GRANULE CELL DIFFERENTIATION PROTEIN).//4.60E−10//93aa//36%//P80144
CTONG20174290//TRICHOHYALIN.//1.30E−07//340aa//21%//P37709
CTONG20174440
CTONG20174580//*Homo sapiens* mRNA for vascular Rab-GAP/TBC-containing protein complete cds.//1.00E−115//335aa//61%//NP_008994
CTONG20176040//ADP-RIBOSYLATION FACTOR-LIKE PROTEIN 3 (ARD3).//1.70E−34//155aa//43%//P37996
CTONG20179390
CTONG20179890
CTONG20179980
CTONG20180620
CTONG20180690
CTONG20181350
CTONG20183430//ANKYRIN 2 (BRAIN ANKYRIN) (ANKYRIN B) (ANKYRIN, NONERYTHROID).//4.60E−30//311aa//32%//Q01484
CTONG20183830//IRLB [*Homo sapiens*]//1.50E−104//191aa//100%//CAA45013
CTONG20184130
CTONG20184830//ATP-BINDING CASSETTE, SUBFAMILY A, MEMBER 1 (ATP-BINDING CASSETTE TRANSPORTER 1) (ATP-BINDING CASSETTE 1).//1.30E−63//271aa//47%//P41233
CTONG20186140
CTONG20186290//ALDEHYDE DEHYDROGENASE, DIMERIC NADP-PREFERRING (EC 1.2.1.5) (ALDH CLASS 3).//1.50E−74//144aa//100%//P30838
CTONG20186370//ZINC FINGER PROTEIN 84 (ZINC FINGER PROTEIN HPF2).//2.60E−52//324aa//33%//P51523
CTONG20186520//ZINC FINGER PROTEIN MFG-3.//1.40E−197//643aa//53%//P16374
CTONG20186550//cca3 protein—rat //2.10E−37//141aa//56%//T31081
CTONG20188080
CTONG20189000//PROBABLE GUANINE NUCLEOTIDE REGULATORY PROTEIN TIM (ONCOGENE TIM) (P60 TIM) (TRANSFORMING IMMORTALIZED MAMMARY ONCOGENE).//1.10E−48//222aa//50%//Q12774
CTONG20190290//39.1 KDA PROTEIN IN SURE-CYSC INTERGENIC REGION.//6.00E−15//132aa//31%//Q57261
CTONG20190630
DFNES20016470//*Homo sapiens* SDP1 protein mRNA, complete cds.//4.90E−33//95aa//37%//AF076957
DFNES20018000//CADHERIN-RELATED TUMOR SUPPRESSOR PRECURSOR (FAT PROTEIN).//8.70E−23//306aa//30%//P33450
DFNES20025500//*Homo sapiens* mRNA for paraplegin-like protein.//3.00E−29//68aa//94%//Y18314
DFNES20028170//Mouse mRNA for RNA polymerase I associated factor (PAF53), complete cds.//1.40E−165//393aa//78%//D14336
DFNES20029660
DFNES20032550
DFNES20043710
DFNES20046840//FORKHEAD BOX PROTEIN E1 (FORKHEAD-RELATED PROTEIN FKHL15) (THYROID TRANSCRIPTION FACTOR 2) (TTF-2).//6.20E−05//151aa//32%//O00358
DFNES20055400//*Homo sapiens* diphthamide biosynthesis protein-2 (DPH2) mRNA, complete cds.//5.40E−203//413aa//91%//AF053003
DFNES20057660//GRAVE'S DISEASE CARRIER PROTEIN (GDC) (MITOCHONDRIAL SOLUTE CARRIER PROTEIN HOMOLOG).//7.00E−31//247aa//33%//Q01888
DFNES20063460//PAB-DEPENDENT POLY (A)-SPECIFIC RIBONUCLEASE SUBUNIT PAN3 (EC 3.1.13.4) (PAB1P-DEPENDENT POLY(A)-NUCLEASE).//1.90E−23//115aa//43%//P36102
DFNES20072990//HYPOTHETICAL 46.7 KDA PROTEIN IN HOR7-COX7 INTERGENIC REGION.//1.80E−22//310aa//25%//Q04835
DFNES20073320//*Mus musculus* RING-finger protein MURF mRNA, complete cds.//6.70E−118//362aa//61%//AF294790
DFNES20076340
DFNES20080880//POLYPEPTIDE N-ACETYLGALACTOSAMINYLTRANSFERASE (EC 2.4.1.41) (PROTEIN-UDP ACETYLGALACTOSAMINYLTRANSFERASE) (UDP-GALNAC:POLYPEPTIDE, N-ACETYLGALACTOSAMINYLTRANSFERASE) (GALNAC-T1).//2.00E−104//486aa//43%//Q10472
DFNES20088810
DFNES20094820//coronin-like protein [*Schizosaccharomyces pombe*]//3.60E−20//333aa//24%//CAB11184
FCBBF10000230//*H.sapiens* mRNA from TYL gene.//3.30E−155//650aa//51%//X99688
FCBBF10002200
FCBBF10004760//*Homo sapiens* GAP-like protein (N61) mRNA, complete cds.//9.10E−82//412aa//44%//AF251038
FCBBF20018680//RABPHILIN-3A.//1.70E−16//262aa//30%//P47709
FCBBF20020440
FCBBF20021110
FCBBF20023490//PUTATIVE PRE-mRNA SPLICING FACTOR ATP-DEPENDENT RNA HELICASE SPAC10F6. 02C.//1.20E−90//505aa//39%//042643
FCBBF20028980
FCBBF20029280
FCBBF20032930
FCBBF20033360//RING CANAL PROTEIN (KELCH PROTEIN).//7.40E−33//234aa//32%//Q04652
FCBBF20035430//*Mus musculus* arsenite inducible RNA associated protein (Airap) mRNA, complete cds.//1.50E−51//152aa//57%//AF224494
FCBBF20035490//GAP-associated tyrosine phosphoprotein p62 (Sam68) [*Homo sapiens*] >pir||A38219 GAP-associated tyrosine phosphoprotein p62//1.50E−214//415aa//93%//NP_006550
FCBBF20036360
FCBBF20038230
FCBBF20038950
FCBBF20041380
FCBBF20043730
FCBBF20054390
FCBBF20056580//*Mus musculus* NSD1 protein mRNA, complete cds.//3.40E−304//773aa//75%//AF064553
FCBBF20059660
FCBBF20061310
FCBBF20066340//*Homo sapiens* nuclear dual-specificity phosphatase (SBF1) mRNA, partial cds.//1.20E−68//312aa//49%//U93181

FCBBF20070800
FCBBF20070950//MICRONUCLEAR LINKER HISTONE POLYPROTEIN (MIC LH) [CONTAINS: LINKER HISTONE PROTEINS ALPHA, BETA, DELTA AND GAMMA].//5.00E-10//601aa//20%//P40631
FCBBF30000010
FCBBF30001020
FCBBF30001100//CRAG protein [*Drosophila melanogaster*]//7.40E-185//800aa//46%//CAA76938
FCBBF30001150
FCBBF30002270//HISTONE H1'-(H1.0) (H1(0)).//4.90E-62//154aa//84%//P07305
FCBBF30002280//THIOREDOXIN PEROXIDASE 2 (THIOREDOXIN-DEPENDENT PEROXIDE REDUCTASE 2) (PROLIFERATION-ASSOCIATED PROTEIN PAG) (NATURAL KILLER CELL ENHANCING FACTOR A) (NKEF-A).//1.20E-27//61aa//98%//Q06830
FCBBF30002330
FCBBF30003610//ZINC FINGER PROTEIN 91 (ZINC FINGER PROTEIN HTF10) (HPF7).//9.10E-93//313aa//53%//Q05481
FCBBF30004340//*Homo sapiens* GalNAc-T9 mRNA for UDP-GalNAc:polypeptide N-acetylgalactosaminyltransferase, complete cds.//1.60E-109//299aa//63%//AB040672
FCBBF30004730
FCBBF30005180
FCBBF30005360//*Mus musculus* spermatogenesis associated factor (SPAF) mRNA, complete cds.//0//894aa//84%//AF049099
FCBBF30005500//HYPOTHETICAL PROTEIN KIAA0167.//5.80E-16//124aa//36%//Q99490
FCBBF30019140//CHROMODOMAIN HELICASE-DNA-BINDING PROTEIN 3 (CHD-3) (MI-2 AUTOANTIGEN 240 KDA PROTEIN) (MI2-ALPHA).//0//725aa//82%//Q12873
FCBBF30019180//SERINE/THREONINE PROTEIN PHOSPHATASE 2A, 65 KDA REGULATORY SUBUNIT A, ALPHA ISOFORM (PP2A, SUBUNIT A, PR65-ALPHA ISOFORM) (PP2A, SUBUNIT A, R1-ALPHA ISOFORM).//4.60E-233//451aa//98%//P54612
FCBBF30019240
FCBBF30021900//ZINC FINGER PROTEIN 91 (ZINC FINGER PROTEIN HTF10) (HPF7).//4.10E-161//633aa//48%//Q05481
FCBBF30022680//putative 5'-3' exonuclease//9.00E-12//200aa//25%//AAG29662
FCBBF30026580//*Homo sapiens* retinoblastoma-associated protein RAP140 mRNA, complete cds.//7.60E-27//367aa//28%//AF180425
FCBBF30029250//GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE).//4.00E-18//754aa//23%//P08640
FCBBF30035570
FCBBF30042610//*Homo sapiens* CTL2 gene.//2.10E-137//393aa//60%//AJ245621
FCBBF30048420//TBX19 PROTEIN (T-BOX PROTEIN 19).//1.40E-94//212aa//85%//O60806
FCBBF30053300//Human autoantigen pericentriol material 1 (PCM-1) mRNA, complete cds.//0//708aa//90%//L27841
FCBBF30056980
FCBBF30062490//*Mus musculus* prominin-like protein mRNA, partial cds.//7.70E-85//210aa//79%//AF128113
FCBBF30063990
FCBBF30068210
FCBBF30071500//*Homo sapiens* dentin phosphoryn mRNA, complete cds.//2.80E-09//675aa//22%//AF094508
FCBBF30072440//*Homo sapiens* SARDH mRNA, alternatively spliced, complete cds.//1.70E-14//81aa//53%//AF095737
FCBBF30072480
FCBBF30074530
FCBBF30074620
FCBBF30075970
FCBBF30076310//CAMP-DEPENDENT PROTEIN KINASE, BETA-CATALYTIC SUBUNIT (EC 2.7.1.37) (PKA C-BETA).//8.20E-166//240aa//100%//P22694
FCBBF30078600
FCBBF30079770
FCBBF30080730//SPLICING FACTOR, ARGININE/SERINE-RICH 7 (SPLICING FACTOR 9G8).//3.40E-70//136aa//95%//Q16629
FCBBF30081000
FCBBF30085560//HYPOTHETICAL 60.3 KDA PROTEIN R13G10.2 IN CHROMOSOME III.//1.10E-87//531aa//38%//Q21988
FCBBF30088700
FCBBF30089380
FCBBF30091010
FCBBF30091520//GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE).//3.70E-09//631aa//21%//P08640
FCBBF30093170//ZINC FINGER PROTEIN 84 (ZINC FINGER PROTEIN HPF2).//2.10E-63//173aa//65%//P51523
FCBBF30095410
FCBBF30099490
FCBBF30100080//ARF NUCLEOTIDE-BINDING SITE OPENER (ARNO PROTEIN) (ARF EXCHANGE FACTOR).//1.10E-57//108aa//100%//Q99418
FCBBF30100120//*Mus musculus* semaphorin cytoplasmic domain-associated protein 3A (Semcap3) mRNA, complete cds.//2.10E-192//769aa//50%//AF127084
FCBBF30100410//*Mus musculus* testis-specific Y-encoded-like protein (Tspyl1) mRNA, complete cds.//1.90E-56//324aa//42%//AF042180
FCBBF30101240
FCBBF30101300
FCBBF30105080
FCBBF30105440//*Rattus norvegicus* ion transporter protein (NRITP) mRNA, partial cds.//3.40E-36//82aa//91%//AF184921
FCBBF30105860//microtubule associated-protein orbit [*Drosophila melanogaster*].//1.00E-79//556aa//33%//BAA94248
FCBBF30106950
FCBBF30107290//MITOCHONDRIAL PROCESSING PEPTIDASE ALPHA SUBUNIT PRECURSOR (EC 3.4.24.64) (ALPHA-MPP) (P-55) (HA1523) (KIAA0123).//1.00E-91//172aa//100%//Q10713
FCBBF30107330
FCBBF30114180
FCBBF30114850//*Homo sapiens* C2H2 (Kruppel-type) zinc finger protein mRNA, complete cds.//3.20E-24//249aa//34%//AF159567
FCBBF30115230
FCBBF30115920//*Homo sapiens* nolp mRNA, complete cds.//9.40E-220//257aa//100%//AB017800

FCBBF30118670//*Homo sapiens* disintegrin and metalloproteinase domain 19 (ADAM19) mRNA, partial cds.//0//601aa//97%//AF134707
FCBBF30118890//*Drosophila melanogaster* La related protein (larp) mRNA, partial cds.//6.70E−25//221aa//35%//AF221108
FCBBF30125460
FCBBF30125880//*Homo sapiens* single-strand selective monofunctional uracil DNA glycosylase mRNA, complete cds.//6.40E−81//96aa//100%//AF125182
FCBBF30128420
FCBBF30129010//ZINC FINGER PROTEIN 36 (ZINC FINGER PROTEIN KOX18) (FRAGMENT).//1.20E−179//322aa//100%//P17029
FCBBF30130410//CALDESMON (CDM).//3.30E−06//170aa//32%//P12957
FCBBF30130580
FCBBF30132050//*Homo sapiens* mRNA for UDP-galactose:2-acetamido-2-deoxy-D-glucose3beta-galactosyltransferase.//2.10E−43//253aa//36%//Y15014
FCBBF30132660//*Drosophila melanogaster* Canton S tartan protein (trn) mRNA, complete cds.//2.00E−15//293aa//30%//U02078
FCBBF30135890//GLUTENIN, LOW MOLECULAR WEIGHT SUBUNIT PRECURSOR.//2.60E−07//163aa//34%//P10385
FCBBF30136230//NIL-2-A ZINC FINGER PROTEIN (NEGATIVE REGULATOR OF IL2) (TRANSCRIPTION FACTOR 8).//0//1090aa//94%//P37275
FCBBF30138000//trg protein—rat//1.30E−82//560aa//37%//I60486
FCBBF30142290//dJ127B20.3 (novel PHD finger protein) [*Homo sapiens*].//1.00E−140//287aa//96%//CAB62994
FCBBF30143550//FYVE FINGER-CONTAINING PHOSPHOINOSITIDE KINASE (EC 2.7.1.68) (1-PHOSPHATIDYLINOSITOL-4-PHOSPHATE KINASE) (PIP5K) (PTDINS(4)P-5-KINASE) (P235).//0//1027aa//91%//Q9Z1T6
FCBBF30145670
FCBBF30151190
FCBBF30153170//6-PHOSPHOFRUCTOKINASE, LIVER TYPE (EC 2.7.1.11) (PHOSPHOFRUCTOKINASE 1) (PHOSPHOHEXOKINASE) (PHOSPHOFRUCTO-1-KINASE ISOZYME B).//0//670aa//99%//P17858
FCBBF30157270//*Rattus norvegicus* PAPIN mRNA, complete cds.//1.20E−179//639aa//58%//AF169411
FCBBF30161780
FCBBF30164510//RETINAL-CADHERIN PRECURSOR (R-CADHERIN) (R-CAD).//0//794aa//98%//P55283
FCBBF30166220//SERINE HYDROXYMETHYLTRANSFERASE, CYTOSOLIC (EC 2.1.2.1) (SERINE METHYLASE) (GLYCINE HYDROXYMETHYLTRANSFERASE) (SHMT).//2.70E−12//33aa//100%//P34896
FCBBF30169280//Petunia×hybrida PGPD14 (PGPD14) mRNA, complete cds.//1.40E−62//261aa//42%//AF049930
FCBBF30169870
FCBBF30170710
FCBBF30171230//NEUROENDOCRINE CONVERTASE 2 PRECURSOR (EC 3.4.21.94) (NEC 2) (PC2) (PROHORMONE CONVERTASE 2) (PROPROTEIN CONVERTASE 2) (KEX2-LIKE ENDOPROTEASE 2).//1.70E−82//181aa//86%//P16519
FCBBF30172330
FCBBF30173960//erythroid differentiation-related factor 1 [*Homo sapiens*].//6.00E−32//113aa//100%//AAC00001
FCBBF30175350//MITOGEN-ACTIVATED PROTEIN KINASE 7 (EC 2.7.1.-) (EXTRACELLULAR SIGNAL-REGULATED KINASE 5) (ERK5) (ERK4) (BMK1 KINASE).//4.60E−06//245aa//28%//Q13164
FCBBF30177290//HYPOTHETICAL 47.6 KDA PROTEIN C16C10.5 IN CHROMOSOME III.//2.40E−28//133aa//46%//Q09251
FCBBF30179180
FCBBF30179740
FCBBF30181730
FCBBF30194370
FCBBF30194550//ANKYRIN 1 (ERYTHROCYTE ANKYRIN) (ANKYRIN R) (ANKYRINS 2.1 AND 2.2).//9.90E−54//478aa//33%//P16157
FCBBF30195690//SYNAPTOTAGMIN I.//1.30E−27//138aa//31%//P34693
FCBBF30195700
FCBBF30197840//Mouse mRNA for seizure-related gene product 6 type 2 precursor, complete cds.//0//869aa//91%//D64009
FCBBF30198670//dof protein—fruit fly (*Drosophila melanogaster*)//6.60E−05//272aa//24%//T13712
FCBBF30201630//*Chlamydomonas reinhardtii* dhc1 gene for 1-alpha dynein heavy chain.//1.10E−121//384aa//58%//AJ243806
FCBBF30212210
FCBBF30215240//mitogen inducible gene mig-2—human//2.20E−135//263aa//96%//S69890
FCBBF30220050//OXYSTEROLS RECEPTOR LXR-BETA (LIVER X RECEPTOR BETA) (NUCLEAR ORPHAN RECEPTOR LXR-BETA) (UBIQUITOUSLY-EXPRESSED NUCLEAR RECEPTOR) (NUCLEAR RECEPTOR NER).//6.90E−96//167aa//100%//P55055
FCBBF30222910//*Mus musculus* Rap2 interacting protein 8 (RPIP8) mRNA, complete cds.//4.70E−29//76aa//46%//U73941
FCBBF30223110
FCBBF30223210//PLEXIN 4 PRECURSOR (TRANSMEMBRANE PROTEIN SEX).//1.70E−72//179aa//76%//P51805
FCBBF30225930
FCBBF30228940//*Homo sapiens* zinc finger protein dp mRNA, complete cds.//2.60E−14//114aa//42%//AF153201
FCBBF30230610
FCBBF30236670//*Homo sapiens* DEAD-box protein abstrakt (ABS) mRNA, complete cds.//1.00E−128//276aa//91%//AF195417
FCBBF30250980//GUANINE NUCLEOTIDE-BINDING PROTEIN BETA SUBUNIT-LIKE PROTEIN.//3.20E−06//190aa//28%//O24076
FCBBF30255680//*Rattus norvegicus* brain specific cortactin-binding protein CBP90 mRNA, partial cds.//1.80E−275//641aa//82%//AF053768
FCBBF30257370//CARNITINE DEFICIENCY-ASSOCIATED PROTEIN EXPRESSED IN VENTRICLE 1 (CDV-1 PROTEIN).//2.80E−169//355aa//92%//O35594
FCBBF30259050//*Mus musculus* (clone pMLZ-1) zinc finger protein (Zfp) mRNA, 3' end of cds.//1.40E−241//499aa//83%//L36315
FCBBF30260210//*Drosophila melanogaster* KISMET-L long isoform (kis) mRNA, complete cds.//3.90E−178//420aa//68%//AF215703
FCBBF30260480//*Mus musculus* putative E1-E2 ATPase mRNA, partial cds.//1.80E−78//154aa//95%//AF156547

FCBBF30263080//ZINC FINGER PROTEIN 83 (ZINC FINGER PROTEIN HPF1).//4.20E-33//107aa//58%//P51522
FCBBF30266510
FCBBF30271990//ANKYRIN 1 (ERYTHROCYTE ANKYRIN).//3.00E-43//419aa//33%//Q02357
FCBBF30275590//dedicator of cyto-kinesis 1 [Homo sapiens].//1.00E-138//791aa//37%//NP_001371
FCBBF30282020//cca3 protein—rat//5.50E-249//492aa//94%//T31081
FCBBF30285930//ZINC FINGER PROTEIN ZFP-1 (MKR1 PROTEIN).//5.70E-68//125aa//97%//P08042
FCBBF30287940
FCBBF40000610//late gestation lung 2 protein [Rattus norvegicus].//5.00E-86//178aa//94%//AAF44721
FCBBF40001920
FCBBF40005000
FCBBF50000410
FCBBF50000610
FCBBF50001650//Homo sapiens JP3 mRNA for junctophilin type3, complete cds.//1.20E-111//407aa//57%//AB042636
FCBBF50003530//H. sapiens mRNA for dinG gene.//2.70E-137//181aa//100%//Y10571
FCBBF50004950
FEBRA20005040//MYOSIN HEAVY CHAIN, STRIATED MUSCLE.//1.90E-13//479aa//23%//P24733
FEBRA20007820//MLN 64 PROTEIN (CAB1 PROTEIN).//7.00E-31//129aa//51%//Q14849
FEBRA20018670
FEBRA20026820//ZINC FINGER PROTEIN 91 (ZINC FINGER PROTEIN HTF10) (HPF7).//2.20E-135//431aa//50%//Q05481
FEBRA20027070//ZINC FINGER PROTEIN 41 (FRAGMENT).//1.00E-139//333aa//70%//P51814
FEBRA20029620
FEBRA20031000//TRICHOHYALIN.//2.20E-16//360aa//26%//P37709
FEBRA20031150//Homo sapiens HSKM-B (HSKM-B) mRNA, complete cds.//2.00E-29//63aa//100%//AF226053
FEBRA20031280
FEBRA20031810
FEBRA20035200
FEBRA20035240//SPLICEOSOME ASSOCIATED PROTEIN 49 (SAP 49) (SF3B53).//7.30E-05//108aa//31%//Q15427
FEBRA20038220//GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE).//7.50E-05//256aa//24%//P08640
FEBRA20038330
FEBRA20038970//Homo sapiens mRNA for stabilin-1 (stab1 gene).//1.30E-242//413aa//99%//AJ275213
FEBRA20039070
FEBRA20039260//NonF [Streptomyces griseus subsp. griseus].//2.20E-16//140aa//38%//AAD37457
FEBRA20040230
FEBRA20040260
FEBRA20040290
FEBRA20040560//Homo sapiens delta-6 fatty acid desaturase (CYB5RP) mRNA, complete cds.//1.70E-112//204aa//100%//AF134404
FEBRA20045380//EVI-5 homolog [Homo sapiens].//7.00E-49//130aa//81%//AAC16031
FEBRA20046200//ANKYRIN 2 (BRAIN ANKYRIN) (ANKYRIN B) (ANKYRIN, NONERYTHROID).//1.70E-25//368aa//30%//Q01484
FEBRA20046280
FEBRA20046510//ZINC FINGER PROTEIN 135.//1.10E-94//260aa//62%//P52742
FEBRA20057010//ZINC FINGER PROTEIN 195.//1.30E-12//47aa//70%//O14628
FEBRA20063720//ZINC FINGER PROTEIN 85 (ZINC FINGER PROTEIN HPF4) (HTF1).//3.10E-243//586aa//73%//Q03923
FEBRA20076200
FEBRA20078180
FEBRA20078800//NADH-UBIQUINONE OXIDOREDUCTASE 20 KDA SUBUNIT PRECURSOR (EC 1.6.5.3) (EC 1.6.99.3) (COMPLEX I-20KD) (CI-20KD) (PSST SUBUNIT).//2.30E-96//192aa//96%//O75251
FEBRA20080860
FEBRA20082660
FEBRA20083410
FEBRA20084750
FEBRA20086600
FEBRA20087550//damage-specific DNA binding protein 2 (48kD) [Homo sapiens]//1.10E-106//119aa//94%//NP_000098
FEBRA20088610//CELLULAR RETINALDEHYDE-BINDING PROTEIN (CRALBP).//2.40E-14//145aa//30%//P10123
FEBRA20088810//FIBROBLAST GROWTH FACTOR-17 PRECURSOR (FGF-17).//1.00E-102//193aa//99%//O60258
FEBRA20090160//MITOGEN-ACTIVATED PROTEIN KINASE KINASE KINASE 10 (EC 2.7.1.-) (MIXED LINEAGE KINASE 2) (PROTEIN KINASE MST).//1.10E-15//111aa//48%//Q02779
FEBRA20090220//TRANSLATION INITIATION FACTOR EIF-2B EPSILON SUBUNIT (EIF-2B GDP-GTP EXCHANGE FACTOR).//0//721aa//90%//P47823
FEBRA20091620
FEBRA20092760//PINCH PROTEIN (PARTICULARY INTERESTING NEW CYS-HIS PROTEIN).//2.50E-81//165aa//80%//P48059
FEBRA20093270
FEBRA20093280
FEBRA20095410
FEBRA20098040
FEBRA20099860//dynactin 3 (p22); dynactin light chain [Homo sapiens]//1.70E-41//89aa//100%//NP_009165
FEBRA20101410
FEBRA20108020
FEBRA20108580
FEBRA20115930
FEBRA20116650
FEBRA20121200
FEBRA20121950//X INACTIVE SPECIFIC TRANSCRIPT PROTEIN (FRAGMENT).//1.60E-07//155aa//24%//P27571
FEBRA20141980
FEBRA20150420//HYPOTHETICAL 131.5 KDA PROTEIN C02F12.7 IN CHROMOSOME X.//6.90E-56//877aa//24%//Q11102
FEBRA20151750//Mus musculus (clone E5.53) Huntington disease (hdh) gene, exon 5.//2.60E-12//88aa//43%//L34024
FEBRA20163980
FEBRA20170240//ZINC FINGER PROTEIN 75.//7.90E-158//278aa//99%//P51815
FEBRA20172230//Mus musculus schwannoma-associated protein (SAM9) mRNA, complete cds.//1.70E-57//295aa//40%//AF026124

FEBRA20173330//PROTEIN KINASE CLK3 (EC 2.7.1.-).//4.80E−277//490aa//99%//P49761
FEBRA20175020
FEBRA20175330
FEBRA20177800//RNA binding motif protein 9 [*Homo sapiens*].//4.00E−09//75aa//95%//NP_055124
FEBRA20180510
FEBRA20182030
FEBRA20187460
FEBRA20191720//REGULATOR OF G-PROTEIN SIGNALING 11 (RGS11).//2.00E−73//104aa//100%//094810
HCHON10000150//SKELETAL MUSCLE LIM-PROTEIN 1 (SLIM 1) (SLIM) (FOUR AND A HALF LIM DOMAINS PROTEIN 1) (FHL-1).//4.10E−74//154aa//84%//Q13642
HCHON10001660
HCHON20000870//SERINE/THREONINE-PROTEIN KINASE CTR1 (EC 2.7.1.37).//2.10E−21//300aa//26%//Q05609
HCHON20002650//EARLY GROWTH RESPONSE PROTEIN 2 (EGR-2) (KROX-20 PROTEIN).//9.90E−05//166aa//26%//P51774
HCHON20002710//UBIQUITIN CARBOXYL-TERMINAL HYDROLASE 13 (EC 3.1.2.15) (UBIQUITIN THIOLESTERASE 13) (UBIQUITIN-SPECIFIC PROCESSING PROTEASE 13) (DEUBIQUITINATING ENZYME 13).//7.40E−10//114aa//28%//P38187
HCHON20015050//LEUKOCYTE ADHESION GLYCOPROTEIN P150,95 ALPHA CHAIN PRECURSOR (LEUKOCYTE ADHESION RECEPTOR P150,95) (CD11C) (LEU M5) (INTEGRIN ALPHA-X).//8.60E−06//250aa//26%//P20702
HEART10001420//*Mus musculus* skm-BOP1 (Bop) mRNA, complete cds.//6.10E−259//485aa//94%//U76373
HEART10001490//ACTIN INTERACTING PROTEIN 2.//1.80E−71//243aa//58%//P46681
HEART20009590//*Homo sapiens* mRNA for paraplegin-like protein.//7.10E−47//145aa//67%//Y18314
HEART20019310//*Mus musculus* RING-finger protein MURF mRNA, complete cds.//6.70E−118//362aa//61%//AF294790
HEART20022200//METHIONINE AMINOPEPTIDASE 2 (EC 3.4.11.18) (METAP 2) (PEPTIDASE M 2) (INITIATION FACTOR 2 ASSOCIATED 67 KDA GLYCOPROTEIN) (P67).//1.50E−209//447aa//86%//P50579
HEART20031680
HEART20047640//CALCIUM/CALMODULIN-DEPENDENT 3',5'-CYCLIC NUCLEOTIDE PHOSPHODIESTERASE 1C (EC 3.1.4.17) (CAM-PDE 1C).//0//769aa//94%//Q63421
HEART20063100//*H. sapiens* mRNA histone RNA hairpin-binding protein.//5.60E−114//212aa//100%//Z71188
HEART20082570//AMINOMETHYLTRANSFERASE PRECURSOR (EC 2.1.2.10) (GLYCINE CLEAVAGE SYSTEM T PROTEIN).//5.50E−113//210aa//69%//P28337
HHDPC10001140
HHDPC20051850//STEROID RECEPTOR PROTEIN DG6.//9.50E−43//101aa//89%//015173
HHDPC20081230//NUCLEOLIN (PROTEIN C23).//0//681aa//92%//P19338
HHDPC20082790
HHDPC20082970
HHDPC20088160
HLUNG20008460//DIAPHANOUS PROTEIN HOMOLOG 2.//7.60E−33//521aa//26%//060879
HLUNG20009260
HLUNG20009550
HLUNG20010130
HLUNG20011260//TYROSINE-PROTEIN KINASE SRC-1 (EC 2.7.1.112) (P60-SRC-1).//1.10E−46//92aa//100%//P13115
HLUNG20011440
HLUNG20011460//*Rattus norvegicus* serine-arginine-rich splicing regulatory protein SRRP86 mRNA, complete cds.//1.20E−159//398aa//79%//AF234765
HLUNG20012140
HLUNG20014590//ZINC FINGER PROTEIN 135.//1.20E−122//350aa//59%//P52742
HLUNG20015070//SLIT PROTEIN PRECURSOR.//5.00E−14//167aa//33%//P24014
HLUNG20015180//BALBIANI RING PROTEIN 3 PRECURSOR.//8.80E−08//444aa//24%//Q03376
HLUNG20020500
HLUNG20020850//TLM PROTEIN (TLM ONCOGENE).//5.00E−17//91aa//54%//P17408
HLUNG20021450
HLUNG20023030
HLUNG20024050
HLUNG20025620
HLUNG20028110//zinc finger protein—fission yeast (*Schizosaccharomyces pombe*).//2.70E−23//140aa//38%//T39456
HLUNG20029420
HLUNG20029490
HLUNG20030420//*Mus musculus* mRNA for MAIL, complete cds.//1.00E−164//728aa//68%//AB020974
HLUNG20030490//*Ambystoma tigrinum* RPE65 protein mRNA, complete cds.//1.70E−64//335aa//42%//AF047465
HLUNG20030610
HLUNG20031620
HLUNG20032460//LYSOSOMAL PRO-X CARBOXYPEPTIDASE PRECURSOR (EC 3.4.16.2) (PROLYLCARBOXYPEPTIDASE) (PRCP) (PROLINE CARBOXYPEPTIDASE) (ANGIOTENSINASE C) (LYSOSOMAL CARBOXYPEPTIDASE C).//8.60E−274//440aa//99%//P42785
HLUNG20033060//*Homo sapiens* GAP-like protein (N61) mRNA, complete cds.//1.20E−81//389aa//45%//AF251038
HLUNG20033310
HLUNG20033350
HLUNG20034970
HLUNG20037140
HLUNG20037160//RETROVIRUS-RELATED ENV POLYPROTEIN.//1.90E−131//439aa//54%//P10267
HLUNG20037780
HLUNG20038330
HLUNG20041540//GLUCOAMYLASE S1/S2 PRECURSOR (EC 3.2.1.3) (GLUCAN 1,4-ALPHA-GLUCOSIDASE) (1,4-ALPHA-D-GLUCAN-GLUCOHYDROLASE).//8.80E−08//286aa//24%//P08640
HLUNG20041590//ubiquitous tetratricopeptide containing protein RoXaN [*Homo sapiens*].//1.00E−158//737aa//42%//AAF05541
HLUNG20042730//CYTOCHROME P450 4A4 (EC 1.14.14.1) (CYPIVA4) (PROSTAGLANDIN OMEGA-HYDROXYLASE) (P450-P-2).//4.90E−126//442aa//49%//P10611
HLUNG20045340//MOB2 PROTEIN (MPS1 BINDER 2).//4.60E−27//135aa//37%//P43563

HLUNG20047070
HLUNG20050760
HLUNG20051330
HLUNG20052300//AIG1 PROTEIN.//3.00E−23//216aa//30%//P54120
HLUNG20054790//PHOSPHATIDYLINOSITOL 3-KINASE REGULATORY SUBUNIT (EC 2.7.1.137) (IB PI3-KINASE P101 SUBUNIT) (PTDINS-3-KINASE P101) (PI3K) (P101-PI3K).//8.30E−22//292aa//25%//002696
HLUNG20055240
HLUNG20056560
HLUNG20057380
HLUNG20059240
HLUNG20060670
HLUNG20063700//*H. sapiens* PEBP2aC1 acute myeloid leukaemia mRNA.//3.60E−22//62aa//79%//Z35278
HLUNG20065700
HLUNG20065990//SYNTAXIN 4.//8.80E−127//267aa//96%//Q12846
HLUNG20067810
HLUNG20068120//NUCLEAR TRANSITION PROTEIN 2 (TP-2).//7.10E−06//86aa//38%//P 11101
HLUNG20069350//CALCYPHOSINE.//1.80E−13//128aa//31%//Q13938
HLUNG20070410
HLUNG20072100//*Gallus gallus* Dach2 protein (Dach2) mRNA, complete cds.//1.40E−236//404aa//79%//AF198349
HLUNG20072190
HLUNG20072450
HLUNG20074330
HLUNG20079310
HLUNG20081390//DNAJ PROTEIN.//1.60E−17//98aa//47%//P35515
HLUNG20081530//NEUROFILAMENT TRIPLET H PROTEIN (200 KDA NEUROFILAMENT PROTEIN) (NF—H).//1.90E−09//220aa//25%//P12036
HLUNG20082350//*Homo sapiens* goodpasture antigen-binding protein (COL4A3BP) mRNA, complete cds.//0//399aa//93%//AF136450
HLUNG20083330//alpha1 (III) collagen [*Homo sapiens*]//5.40E−61//113aa//99%//CAA29886
HLUNG20083480//Chicken mRNA for TSC-22 variant, complete cds, clone SLFEST52.//9.00E−178//527aa//68%//D82364
HLUNG20083840
HLUNG20083960
HLUNG20084790//HYPOTHETICAL 65.2 KDA TRP-ASP REPEATS CONTAINING PROTEIN D2030.9 IN CHROMOSOME I.//5.50E−47//161aa//53%//P90794
HLUNG20085210//*Homo sapiens* intersectin 2 (SH3D1B) mRNA, complete cds.//9.60E−28//62aa//95%//AF248540
HLUNG20088750
HLUNG20092530
HLUNG20093030
HLUNG20094130
KIDNE20011600
KIDNE20016360//*Rattus norvegicus* potassium channel (erg2) mRNA, complete cds.//0//418aa//96%//AF016192
KIDNE20024380
KIDNE20027980
KIDNE20080690//PROBABLE AMINOTRANSFERASE T01B11.2 (EC 2.6.1.-).//5.80E−114//445aa//48%//P91408
KIDNE20081170//*Homo sapiens* microtubule-based motor (HsKIFC3) mRNA, complete cds.//6.20E−153//216aa//99%//AF004426
KIDNE20083150
KIDNE20083620//L-ASPARAGINASE (EC 3.5.1.1) (L-ASPARAGINE AMIDOHYDROLASE).//2.60E−53//148aa//43%//Q9ZSD6
KIDNE20084030
KIDNE20084040//PHOSPHOLIPASE D1 (EC 3.1.4.4) (PLD 1) (CHOLINE PHOSPHATASE 1) (PHOSPHATIDYLCHOLINE-HYDROLYZING PHOSPHOLIPASE D1).//3.30E−70//134aa//100%//Q13393
KIDNE20084730//*Homo sapiens* FH1/FH2 domain-containing protein FHOS (FHOS) mRNA, complete cds.//2.60E−148//599aa//52%//AF113615
KIDNE20084800
KIDNE20086490
KIDNE20086660
KIDNE20086970
KIDNE20087880
KIDNE20088240//atopy related autoantigen CALC [*Homo sapiens*].//1.00E−26//300aa//26%//CAA76830
KIDNE20089870//HISTONE ACETYLTRANSFERASE TYPE B SUBUNIT 2 (RETINOBLASTOMA BINDING PROTEIN P46) (RETINOBLASTOMA-BINDING PROTEIN 7).//4.30E−237//422aa//99%//Q16576
KIDNE20091090
KIDNE20094260
KIDNE20094670//*Drosophila melanogaster* AAA family protein Bor (bor) mRNA, complete cds.//2.10E−124//399aa//59%//AF227209
KIDNE20095530
KIDNE20133460//*Homo sapiens* mRNA for sperm protein.//3.40E−146//284aa//100%//X91879
KIDNE20133880
KIDNE20134130
KIDNE20134890//CENTROMERIC PROTEIN E (CENP-E PROTEIN).//7.70E−05//169aa//21%//Q02224
KIDNE20137310
KIDNE20138450
KIDNE20140870//zinc finger protein 106 [*Mus musculus*]//2.10E−288//822aa//67%//AF060246
KIDNE20141120
KIDNE20141700//40S RIBOSOMAL PROTEIN S4, X ISOFORM (SINGLE COPY ABUNDANT MRNA PROTEIN) (SCR10).//2.60E−72//153aa//89%//P12750
KIDNE20142680
KIDNE20142900//THROMBOMODULIN PRECURSOR (FETOMODULIN) (TM) (CD141 ANTIGEN).//1.80E−71//119aa//100%//P07204
KIDNE20143200
KIDNE20147170//acetylglutamate synthase—fission yeast (*Schizosaccharomyces pombe*)//8.40E−15//143aa//37%//T40666
KIDNE20148080
KIDNE20149780//NG28 [*Mus musculus*]//3.50E−66//367aa//44%//AAC97966
KIDNE20150730//REGULATOR OF MITOTIC SPINDLE ASSEMBLY 1 (RMSA-1).//2.40E−06//84aa//41%//P49646
KIDNE20152440//*Homo sapiens* mRNA for serin protease with IGF-binding motif, complete cds.//1.80E−181//388aa//93%//D87258
KIDNE20154330//*Rattus norvegicus* mRNA for multi PDZ domain protein.//0//763aa//87%//AJ001320
KIDNE20154830
KIDNE20155980
KIDNE20157100
KIDNE20160360//ARF NUCLEOTIDE-BINDING SITE OPENER (ARNO PROTEIN) (ARF EXCHANGE FACTOR).//7.10E−40//194aa//41%//Q99418

KIDNE20160960
KIDNE20163710
KIDNE20165390//*Homo sapiens* mRNA for beta-tubulin folding cofactor D.//0//709aa//94%//AJ006417
KIDNE20169180//UROMODULIN PRECURSOR (TAMM-HORSFALL URINARY GLYCOPROTEIN) (THP).//0//615aa//99%//P07911
KIDNE20170400
KIDNE20173150//*Bos taurus* mRNA for mitochondrial aralkyl acylCoA:amino acid N-acyltransferase.//2.90E−53//277aa//40%//AJ223301
KIDNE20173430//*Homo sapiens* PDZ domain containing-protein (PDZK1) mRNA, complete cds.//7.90E−28//150aa//34%//AF012281
KIDNE20176030
KIDNE20181670
KIDNE20182540
KIDNE20186170//UDP-GLUCURONOSYLTRANSFERASE 2B13 PRECURSOR, MICROSOMAL (EC 2.4.1.17) (UDPGT) (EGT10).//4.40E−38//214aa//39%//P36512
KIDNE20188630
KIDNE20189890//*Homo sapiens* mRNA for KARP-1-binding protein 2 (KAB2), complete cds.//6.00E−30//177aa//44%//AB022658
KIDNE20189960//TREHALASE PRECURSOR (EC 3.2.1.28) (ALPHA, ALPHA-TREHALASE) (ALPHA, ALPHA-TREHALOSE GLUCOHYDROLASE).//1.40E−224//421aa//97%//043280
KIDNE20191870
LIVER20006260//*Mus musculus* zinc finger protein ZFP113 mRNA, complete cds.//4.50E−183//385aa//85%//AF167320
LIVER20007690
LIVER20007750
LIVER20010510
LIVER20010760//*Homo sapiens* C-type lectin-like receptor-1 mRNA, complete cds.//3.10E−134//208aa//100%//AF200949
LIVER20010990//*Rattus norvegicus* mRNA for putative integral membrane transport protein (UST1r).//7.00E−52//196aa//54%//Y09945
LIVER20011640//Human proline rich calmodulin-dependent protein kinase mRNA, complete cds.//2.00E−116//221aa//97%//U23460
LIVER20013890
LIVER20026440//CYTOCHROME P450 4F3 (EC 1.14.13.30) (CYPIVF3) (LEUKOTRIENE-B4 OMEGA-HYDROXYLASE) (LEUKOTRIENE-B4 20-MONOOXYGENASE) (CYTOCHROME P450-LTB-OMEGA).//2.60E−136//295aa//84%//Q08477
LIVER20030650//WHITE PROTEIN.//7.20E−09//229aa//25%//Q05360
LIVER20032340
LIVER20038000//MITOCHONDRIAL CARNITINE/ACYLCARNITINE CARRIER PROTEIN (CARNITINE/ACYLCARNITINE TRANSLOCASE) (CAC).//9.40E−40//148aa//38%//P97521
LIVER20040740//RETINAL-BINDING PROTEIN (RALBP).//3.10E−60//337aa//37%//P49193
LIVER20055270//SELENIDE, WATER DIKINASE 2 (EC 2.7.9.3) (SELENOPHOSPHATE SYNTHETASE 2) (SELENIUM DONOR PROTEIN 2).//2.70E−204//376aa//97%//Q99611
MESAN20006200//ANNEXIN II (LIPOCORTIN II) (CALPACTIN I HEAVY CHAIN) (CHROMOBINDIN 8) (P36) (PROTEIN I) (PLACENTAL ANTICOAGULANT PROTEIN IV) (PAP-IV).//1.70E−84//174aa//95%//P07355
MESAN20007110
MESAN20008150
MESAN20008940
MESAN20009090//*Homo sapiens* CEGP1 protein (CEGP1), mRNA//1.10E−179//553aa//58%//NM_020974
MESAN20016270//ZINC FINGER PROTEIN 37A (ZINC FINGER PROTEIN KOX21) (FRAGMENT).//1.60E−141//242aa//100%//P17032
MESAN20021130//Human SH3 domain-containing proline-rich kinase (sprk) mRNA, complete cds.//8.20E−168//346aa//91%//U07747
MESAN20021220//INSULIN-LIKE GROWTH FACTOR BINDING PROTEIN COMPLEX ACID LABILE CHAIN PRECURSOR (ALS).//7.40E−26//197aa//30%//002833
MESAN20021470//SPINDLIN (30000 MR METAPHASE COMPLEX) (SSEC P).//3.50E−123//229aa//98%//Q61142
MESAN20021860
MESAN20026870
MESAN20027240//*Rho guanine* nucleotide exchange factor (GEF) 10 [*Homo sapiens*].//1.00E−134//620aa//40%//NP_055444
MESAN20027900//COLLAGEN ALPHA 3(VI) CHAIN PRECURSOR//0//1001aa//98%//P12111
MESAN20029780
MESAN20030350//*Mus musculus* diaphanous-related formin (Dia2) mRNA, complete cds.//6.60E−301//669aa//84%//AF094519
MESAN20030370
MESAN20030390
MESAN20033220//ALDEHYDE DEHYDROGENASE 7 (EC 1.2.1.5).//1.60E−24//54aa//100%//P43353
MESAN20034440//39.1 KDA PROTEIN IN SURE-CYSC INTERGENIC REGION.//2.70E−07//117aa//31%//Q57261
MESAN20038520//DNA-DIRECTED RNA POLYMERASE III 128 KDA POLYPEPTIDE (EC 2.7.7.6) (RNA POLYMERASE III SUBUNIT 2).//0//831aa//70%//P25167
MESAN20041380
MESAN20045750
MESAN20056890//SPLICING FACTOR, ARGININE/SERINE-RICH 2 (SPLICING FACTOR SC35) (SC-35) (SPLICING COMPONENT, 35 KDA) (PR264 PROTEIN).//3.30E−12//97aa//48%//Q01130
MESAN20057240//DNA EXCISION REPAIR PROTEIN ERCC-1.//5.90E−120//195aa//98%//P07992
MESAN20058110//65 KDA FK506-BINDING PROTEIN PRECURSOR (EC 5.2.1.8) (FKBP65) (FKBPRP) (PEPTIDYL-PROLYL CIS-TRANS ISOMERASE) (PPIASE) (ROTAMASE) (IMMUNOPHILIN FKBP65).//8.00E−117//229aa//89%//Q61576
MESAN20059570//*Rattus norvegicus* mRNA for seven transmembrane receptor, complete cds.//1.00E−173//484aa//63%//BAA82518
MESAN20060220
MESAN20060430
MESAN20065990//Human protein serine/threonine kinase stk2 mRNA, complete cds.//2.40E−07//65aa//50%//L20321
MESAN20067430//TROPOMYOSIN, FIBROBLAST ISOFORM TM3.//1.80E−39//87aa//100%//P09494
MESAN20069530//LIM domain only 7 isoform c [*Homo sapiens*]//2.20E−286//545aa//99%//NP_056667
MESAN20084150//*Mus musculus* secretory carrier membrane protein 4 mRNA, complete cds.//2.20E−48//128aa//72%//AF224721

MESAN20085360
MESAN20089260
MESAN20090190//CEGP1 protein [Homo sapiens].//0//880aa//57%//NP_066025
MESAN20094180
MESAN20095220
MESAN20095800//PEPTIDYL-PROLYL CIS-TRANS ISOMERASE 10 (EC 5.2.1.8) (PPIASE) (ROTAMASE) (CYCLOPHILIN-10).//1.60E-31//150aa//46%//P52017
NESOP20004520//LYMPHOCYTE-SPECIFIC PROTEIN LSP1 (PP52 PROTEIN) (52 KDA PHOSPHOPROTEIN) (LYMPHOCYTE-SPECIFIC ANTIGEN WP34).//3.40E-173//321aa//99%//P33241
NESOP20005040
NT2NE20018740
NT2NE20018890//Homo sapiens WD-repeat protein 6 (WDR6) mRNA, complete cds.//6.60E-184//257aa//99%//AF099100
NT2NE20021860//Lytechinus variegatus embryonic blastocoelar extracellular matrix protein precursor (ECM3) mRNA, complete cds.//9.00E-68//466aa//36%//AF287478
NT2NE20026200//TRANSKETOLASE (EC 2.2.1.1) (TK).//1.80E-160//310aa//99%//P29401
NT2NE20026510//basic protein, cytosolic—fruit fly (Drosophila melanogaster)//6.10E-35//202aa//41%//S47857
NT2NE20028700
NT2NE20033150
NT2NE20037050//U2 SMALL NUCLEAR RIBONUCLEOPROTEIN AUXILIARY FACTOR 35 KDA SUBUNIT RELATED-PROTEIN 2.//7.20E-08//109aa//38%//Q15696
NT2NE20038870//ZINC FINGER X-LINKED PROTEIN ZXDA (FRAGMENT).//5.90E-153//405aa//72%//P98168
NT2NE20039210
NT2NE20042550//ADENYLATE KINASE, CHLOROPLAST (EC 2.7.4.3) (ATP-AMP TRANSPHOSPHORYLASE).//7.80E-15//153aa//28%//P43188
NT2NE20045190
NT2NE20047870
NT2NE20053230
NT2NE20053950//ZINC FINGER PROTEIN 136.//6.40E-108//284aa//64%//P52737
NT2NE20059210
NT2NE20059680//Homo sapiens integrin cytoplasmic domain associated protein (Icap-1a) mRNA, complete cds.//1.80E-44//96aa//100%//AF012023
NT2NE20060750//ZINC FINGER PROTEIN ZFP-36 (FRAGMENT).//1.20E-69//198aa//68%//P16415
NT2NE20061030//ZINC FINGER PROTEIN 165.//3.00E-39//125aa//65%//P49910
NT2NE20062880
NT2NE20064780//A-AGGLUTININ ATTACHMENT SUBUNIT PRECURSOR.//4.10E-05//443aa//24%//P32323
NT2NE20066590
NT2NE20069580
NT2NE20070520
NT2NE20073650
NT2NE20077250//Homo sapiens cell cycle progression 2 protein (CPR2) mRNA, complete cds.//1.20E-173//349aa//94%//AF011792
NT2NE20077270
NT2NE20077860
NT2NE20079670//ZINC FINGER PROTEIN 84 (ZINC FINGER PROTEIN HPF2).//2.60E-98//345aa//47%//P51523
NT2NE20080770
NT2NE20082130
NT2NE20082600//Homo sapiens zinc finger protein dp mRNA, complete cds.//2.10E-19//163aa//42%//AF153201
NT2NE20086070
NT2NE20087270//Homo sapiens putative RNA binding protein mRNA, alternatively spliced, complete cds.//4.30E-14//221aa//29%//AF119121
NT2NE20087850//ANTER-SPECIFIC PROLINE-RICH PROTEIN APG (PROTEIN CEX) (FRAGMENT).//1.80E-08//75aa//40%//P40603
NT2NE20088030
NT2NE20092950
NT2NE20095230//Homo sapiens HSKM-B (HSKM-B) mRNA, complete cds.//1.40E-09//112aa//32%//AF226053
NT2NE20104000
NT2NE20107810
NT2NE20108420//KES1 PROTEIN.//4.70E-25//312aa//31%//P35844
NT2NE20111190//C-TERMINAL BINDING PROTEIN 2.//9.00E-54//137aa//84%//P56545
NT2NE20112210
NT2NE20114850
NT2NE20117580//NADH-UBIQUINONE OXIDOREDUCTASE 20 KDA SUBUNIT PRECURSOR (EC 1.6.5.3) (EC 1.6.99.3) (COMPLEX I-20KD) (CI-20KD) (PSST SUBUNIT).//1.20E-76//153aa//95%//O75251
NT2NE20119980//TUMOR NECROSIS FACTOR, ALPHA-INDUCED PROTEIN 1, ENDOTHELIAL (B12 PROTEIN).//6.10E-48//135aa//74%//Q13829
NT2NE20123610
NT2NE20124570
NT2NE20126030
NT2NE20127900//Homo sapiens myo-inositol 1-phosphate synthase A1 (ISYNA1) mRNA, complete cds.//1.40E-269//465aa//99%//AF220530
NT2NE20140130//SEMAPHORIN 3B PRECURSOR (SEMAPHORIN V) (SEMA V).//1.90E-42//90aa//100%//Q13214
NT2NE20140280
NT2NE20141040//DOWN SYNDROME CRITICAL REGION PROTEIN 1.//1.80E-105//197aa//99%//P53805
NT2NE20145250//SCG10 PROTEIN (SUPERIOR CERVICAL GANGLION-10 PROTEIN).//2.50E-58//141aa//88%//P55821
NT2NE20146510//HYPOTHETICAL 104.7 KDA PROTEIN F23F12.8 IN CHROMOSOME III PRECURSOR.//6.20E-08//179aa//23%//P46504
NT2NE20148690
NT2NE20149500
NT2NE20150610
NT2NE20152620
NT2NE20153620//mitogen inducible gene mig-2—human//7.90E-147//449aa//63%//S69890
NT2NE20155650//RETROVIRUS-RELATED ENV POLYPROTEIN.//2.30E-29//114aa//33%//P10267
NT2NE20157120
NT2NE20165190
NT2NE20167660//Mus musculus nuclear localization signal binding protein (spot-1) mRNA, complete cds.//3.50E-09//76aa//40%//S79410

NT2NE20173970//*Rattus norvegicus* beta-catenin binding protein mRNA, complete cds.//1.60E-24//134aa//46%//AF169825

NT2NE20177210//*Leishmania major* partial ppg1 gene for proteophosphoglycan.//1.10E-06//169aa//27%//AJ243460

NT2NE20181760

NT2NE20181800

NT2NE20184720

NT2RI20016240

NT2RI20021200

NT2RI20033920

NT2RI20093010//BIFUNCTIONAL METHYLENETETRAHYDROFOLATE DEHYDROGENASE/CYCLOHYDROLASE, MITOCHONDRIAL PRECURSOR [INCLUDES: NAD-DEPENDENT METHYLENETETRAHYDROFOLATE DEHYDROGENASE (EC 1.5.1.15); METHENYLTETRAHYDROFOLATE CYCLOHYDROLASE (EC 3.5.4.9)].//5.90E-34//86aa//81%//P13995

NT2RP70001120//GA BINDING PROTEIN BETA-1 CHAIN (GABP-BETA-1 SUBUNIT) (GABPB1).//2.50E-113//384aa//62%//Q00420

NT2RP70001730//*Mus musculus* actin-binding protein (ENC-1) mRNA, complete cds.//4.30E-249//589aa//74%//U65079

NT2RP70003110//ELASTIN PRECURSOR (TROPOELASTIN).//1.40E-165//613aa//61%//P15502

NT2RP70012830//CALPHOTIN.//7.90E-17//445aa//28%//Q02910

NT2RP70022820

NT2RP70027790//RAS SUPPRESSOR PROTEIN 1 (RSU-1) (RSP-1 PROTEIN), (RSP-1).//3.80E-23//186aa//34%//Q01730

NT2RP70029780//ZINC FINGER PROTEIN ZFP-36 (FRAGMENT).//4.30E-118//381aa//56%//P16415

NT2RP70030840//*Mus musculus* schlafen3 (Slfn3) mRNA, complete cds.//3.70E-55//328aa//33%//AF099974

NT2RP70031070//36 KDA NUCLEOLAR PROTEIN HNP36 (DELAYED-EARLY RESPONSE PROTEIN 12) (DER12).//1.20E-23//169aa//34%//Q61672

NT2RP70031340

NT2RP70031480

NT2RP70035110//*Caenorhabditis elegans* UNC-89 (unc-89) gene, complete cds.//1.50E-07//229aa//26%//U33058

NT2RP70046410//BASONUCLIN.//3.60E-71//318aa//43%//Q01954

NT2RP70049610

NT2RP70056290

NT2RP70056690//F-SPONDIN PRECURSOR.//2.20E-15//366aa//24%//P35447

NT2RP70057500//Hypothetical zinc finger-like protein [*Homo sapiens*].//0//799aa//94%//AAF88107

NT2RP70064570//CALPAIN P94, LARGE [CATALYTIC] SUBUNIT (EC 3.4.22.17) (CALCIUM-ACTIVATED NEUTRAL PROTEINASE) (CANP) (P94 PROTEIN) (MUSCLE-SPECIFIC CALCIUM-ACTIVATED NEUTRAL PROTEASE 3 LARGE SUBUNIT).//9.40E-86//278aa//40%//Q64691

NT2RP70074800

NT2RP70075300//ZINC FINGER PROTEIN 211 (ZINC FINGER PROTEIN C2H2-25).//9.60E-121//333aa//63%//Q13398

NT2RP70075800//HYPOTHETICAL 43.1 KDA TRP-ASP REPEATS CONTAINING PROTEIN K04G11.4 IN CHROMOSOME X.//1.80E-13//244aa//25%//Q93847

NT2RP70080150

NT2RP70084540

NT2RP70087140//SKIN SECRETORY PROTEIN XP2 PRECURSOR (APEG PROTEIN).//1.40E-11//264aa//31%//P17437

NT2RP70090870//ZINC FINGER PROTEIN 91 (ZINC FINGER PROTEIN HTF10) (HPF7).//4.20E-230//592aa//61%//Q05481

NTONG20002230//*Mus musculus* RW1 protein mRNA, complete cds.//5.20E-97//546aa//34%//AF060565

NTONG20005310

NTONG20017620

NTONG20029850//CALCYPHOSINE (R2D5 ANTIGEN).//1.60E-24//183aa//32%//P41150

NTONG20031580//heat shock 27 kD protein family, member 7 (cardiovascular); cardiovascular heat shock protein [*Homo sapiens*]//6.10E-69//141aa//95%//NP_055239

NTONG20032100//KERATIN, TYPE I CYTOSKELETAL 13 (CYTOKERATIN 13) (K13) (CK 13).//4.20E-175//351aa//96%//P13646

NTONG20034540//CGMP-DEPENDENT 3', 5'-CYCLIC PHOSPHODIESTERASE (EC 3.1.4.17) (CYCLIC GMP STIMULATED PHOSPHODIESTERASE) (CGS-PDE).//0//713aa//99%//000408

NTONG20035150//RING CANAL PROTEIN (KELCH PROTEIN).//9.10E-30//570aa//25%//Q04652

NTONG20043080//MYOSIN LIGHT CHAIN KINASE, SMOOTH MUSCLE AND NON-MUSCLE ISOZYMES (EC 2.7.1.117) (MLCK) [CONTAINS: TELOKIN].//4.30E-12//226aa//28%//P11799

NTONG20048440//P116 RHO-INTERACTING PROTEIN (P116RIP) (RIP3).//1.60E-269//588aa//87%//P97434

NTONG20049180

NTONG20053630//GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE).//1.30E-12//247aa//29%//P08640

NTONG20053730//UBIQUITIN CARBOXYL-TERMINAL HYDROLASE 64E (EC 3.1.2.15) (UBIQUITIN THIOLESTERASE 64E) (UBIQUITIN-SPECIFIC PROCESSING PROTEASE 64E) (DEUBIQUITINATING ENZYME 64E).//8.70E-104//340aa//60%//Q24574

NTONG20053910//*Bos taurus* differentiation enhancing factor 1 (DEF-1) mRNA, complete cds.//2.50E-198//891aa//45%//AF112886

NTONG20055200//ELONGATION FACTOR G, MITOCHONDRIAL PRECURSOR (MEF-G).//1.10E-269//522aa//83%//Q07803

NTONG20058010//ACETYL-COENZYME A SYNTHETASE (EC 6.2.1.1) (ACETATE—COA LIGASE) (ACYL-ACTIVATING ENZYME).//3.90E-124//398aa//54%//068040

NTONG20058220//*Homo sapiens* phosphoprotein pp75 mRNA, partial cds.//8.60E-14//349aa//25%//AF153085

OCBBF20000740//*Homo sapiens* mRNA for ISLR, complete cds.//3.60E-87//287aa//59%//AB003184

OCBBF20001780

OCBBF20005220//*Rattus norvegicus* Fos-related antigen mRNA, complete cds.//3.40E-233//552aa//84%//U34932

OCBBF20009820

OCBBF20011860//*Mus musculus* epithelial protein lost in neoplasm-a (Eplin) mRNA, complete cds.//4.30E-33//98aa//66%//AF307844

OCBBF20012520//*Homo sapiens* mRNA for ISLR, complete cds.//6.50E-88//287aa//59%//AB003184

OCBBF20016390

OCBBF20016810//enhancer of polycomb [*Mus musculus*]//0//743aa//92%//AF079765
OCBBF20109450
OCBBF20109780
OCBBF20110210//KILON PROTEIN PRECURSOR (KINDRED OF IGLON).//4.30E-182//352aa//94%//Q9Z0J8
OCBBF20110730
OCBBF20111370//BCL2/ADENOVIRUS E1B 19-KDA PROTEIN-INTERACTING PROTEIN 2.//5.70E-84//324aa//52%//O54940
OCBBF20111600//69 KDA ISLET CELL AUTOANTIGEN (ICA69) (ISLET CELL AUTOANTIGEN 1).//1.30E-113//335aa//57%//Q05084
OCBBF20112280//*Mesembryanthemum crystallinum* phosphoenolpyruvate/phosphate translocator precursor (PPT) mRNA, complete cds.//7.00E-09//113aa//30%//AF223359
OCBBF20112320
OCBBF20113110
OCBBF20115360
OCBBF20116250//*Mus musculus* C2H2-type zinc finger protein (Evi9) mRNA, complete cds.//0//592aa//99%//AF051525
OCBBF20117220
OCBBF20118720
OCBBF20119810
OCBBF20120010//*Homo sapiens* zinc metalloprotease ADAMTS6 (ADAMTS6) mRNA, complete cds.//1.60E-44//217aa//42%//AF140674
OCBBF20120950//ZINC FINGER PROTEIN 151 (POLYOMAVIRUS LATE INITIATOR PROMOTER BINDING PROTEIN) (LP-1) (ZINC FINGER PROTEIN Z13).//1.00E-28//201aa//34%//Q60821
OCBBF20121910//LAF-4 PROTEIN (LYMPHOID NUCLEAR PROTEIN).//0//740aa//98%//P51826
OCBBF20123200
OCBBF20142290
OCBBF20147070
OCBBF20152330
OCBBF20155030
OCBBF20156450//ZINC FINGER PROTEIN 75.//8.20E-163//289aa//99%//P51815
OCBBF20157970//ZINC FINGER PROTEIN 135.//2.80E-98//306aa//56%//P52742
OCBBF20160380//liver stage antigen LSA-1—*Plasmodium falciparum*//1.10E-21//938aa//24%//A45592
OCBBF20165900//CELL SURFACE ANTIGEN 114/A10 PRECURSOR.//4.80E-09//145aa//31%//P19467
OCBBF20165910//*Mus musculus* pecanex 1 mRNA, complete cds.//4.20E-116//407aa//53%//AF096286
OCBBF20166890//RESTIN (CYTOPLASMIC LINKER PROTEIN-170) (CLIP-170).//4.20E-21//124aa//45%//O42184
OCBBF20166900//ZINC FINGER PROTEIN CLONE 647 (FRAGMENT).//9.00E-18//196aa//30%//P15622
OCBBF20167290//probable acyl-CoA dehydrogenase—*Deinococcus radiodurans* (strain R1)//2.50E-72//222aa//60%//D75616
OCBBF20170350//*Mus musculus* mRNA for GATS protein.//2.50E-56//121aa//96%//AJ296173
OCBBF20174580//G2/MITOTIC-SPECIFIC CYCLIN S13-7 (B-LIKE CYCLIN) (FRAGMENT).//7.10E-16//240aa//25%//P25012
OCBBF20174890//ankyrin 3, long splice form—human//1.10E-150//178aa//100%//A55575
OCBBF20175360//*Homo sapiens* C2H2 (Kruppel-type) zinc finger protein mRNA, complete cds.//3.80E-11//101aa//36%//AF159567
OCBBF20176650
OCBBF20177540//ZINC FINGER PROTEIN MLZ-4 (ZINC FINGER PROTEIN 46).//1.40E-110//223aa//86%//Q03309
OCBBF20177910
OCBBF20182060//*Mesocricetus auratus* guanine nucleotide-binding protein beta 5 (Gnb5) mRNA, complete cds.//7.20E-82//265aa//61%//U13152
OCBBF20185630
OCBBF20188280
OCBBF20191950//VERY LOW-DENSITY LIPOPROTEIN RECEPTOR PRECURSOR (VLDL RECEPTOR).//0//720aa//97%//P98155
PANCR10000860//ELASTASE IIIB PRECURSOR (EC 3.4.21.70) (PROTEASE E).//1.10E-52//87aa//97%//P08861
PEBLM10001470//glutamine (Q)-rich factor 1, QRF-1 [mice, B-cell leukemia, BCL1, Peptide Partial, 84 aa]//5.00E-42//84aa//98%//AAB29272
PEBLM20001800//IG ALPHA-1 CHAIN C REGION.//7.90E-197//353aa//100%//P01876
PEBLM20003260//ZINC FINGER PROTEIN 83 (ZINC FINGER PROTEIN HPF1).//4.90E-62//151aa//70%//P51522
PEBLM20005020
PLACE50001290//HYPOTHETICAL 87.9 KDA PROTEIN F44G4.1 IN CHROMOSOME II PRECURSOR.//2.90E-16//102aa//43%//P54073
PLACE50001390
PLACE60001910
PLACE60004260//CYSTATIN M PRECURSOR (CYSTATIN E).//1.50E-37//81aa//97%//Q15828
PLACE60006300
PLACE60011180
PLACE60012620//LYSOSOMAL TRAFFICKING REGULATOR (BEIGE HOMOLOG).//8.40E-14//128aa//38%//Q99698
PLACE60017120
PLACE60052940//TRANSCRIPTION-REGULATORY PROTEIN GAL11.//1.70E-05//445aa//23%//P32257
PLACE60053280
PLACE60054230//DIAPHANOUS PROTEIN HOMOLOG 2.//1.00E-35//385aa//26%//O60879
PLACE60054820//HYPOTHETICAL PROTEIN KIAA0032.//1.20E-50//180aa//61%//Q15034
PLACE60054870//MYOSIN HEAVY CHAIN, NON-MUSCLE TYPE B (CELLULAR MYOSIN HEAVY CHAIN, TYPE B) (NMMHC-B).//3.70E-11//434aa//20%//P35580
PLACE60056350
PLACE60055460//*Homo sapiens* leucine-zipper protein FKSG13 (FKSG13) mRNA, complete cds.//5.40E-164//327aa//99%//AF312393
PLACE60055590//MYOSIN-BINDING PROTEIN H (MYBP-H) (H-PROTEIN) (86 KDA PROTEIN).//1.30E-05//124aa//35%//Q05623
PLACE60056910
PLACE60057860
PLACE60061370
PLACE60062660//ADP-ribosylation factor binding protein GGA1; ADP-ribosylation factor binding protein; Golgi-associated, gamma-adaptin ear containing, ARF-binding protein 1 [*Homo sapiens*].//6.00E-84//249aa//93%//NP_037497
PLACE60062870
PLACE60063940
PLACE60064180//PUTATIVE PRE-MRNA SPLICING FACTOR ATP-DEPENDENT RNA HELICASE.//1.90E-51//368aa//37%//O22899

PLACE60064740//ADHESIVE PLAQUE MATRIX PROTEIN PRECURSOR (FOOT PROTEIN 1) (MCFP1).//4.80E-11//157aa//31%//Q25434
PLACE60066970//ZINC FINGER PROTEIN 191.//1.30E-36//115aa//48%//O14754
PLACE60068710//SUPPRESSOR PROTEIN SRP40.//9.50E-43//238aa//50%//P32583
PLACE60069880
PLACE60070500
PLACE60071800//CORONIN-LIKE PROTEIN P57.//3.80E-60//108aa//81%//Q92176
PLACE60072390
PLACE60072420
PLACE60073090//*Homo sapiens* myo-inositol 1-phosphate synthase A1 (ISYNA1) mRNA, complete cds.//6.60E-219//362aa//98%//AF220530
PLACE60074820
PLACE60077870
PLACE60080360//mucin [*Homo sapiens*]//5.50E-05//164aa//30%//CAA84032
PLACE60081260
PLACE60082850
PLACE60087680//INSULIN-LIKE GROWTH FACTOR BINDING PROTEIN 3 PRECURSOR (IGFBP-3) (IBP-3) (IGF-BINDING PROTEIN 3).//2.30E-103//255aa//79%//P17936
PLACE60088240
PLACE60092280
PLACE60092370
PLACE60093380
PLACE60095240
PLACE60095600//HYPOTHETICAL HELICASE C28H8.3 IN CHROMOSOME III.//2.70E-28//201aa//38%//Q09475
PLACE60098350//Human hepatocellular carcinoma associated protein (JCL-1) mRNA, complete cds.//5.20E-285//558aa//97%//U92544
PLACE60104630//macrophage migration inhibitory factor (glycosylation-inhibiting factor) [*Homo sapiens*]//9.70E-51//110aa//93%//XP_000858
PLACE60105680//*Homo sapiens* mRNA for TU12B1-TY, complete cds.//1.70E-30//65aa//64%//AB032773
PLACE60107010//SUPPRESSOR PROTEIN SRP40.//3.80E-05//117aa//29%//P32583
PLACE60109910
PLACE60113340//BASEMENT MEMBRANE-SPECIFIC HEPARAN SULFATE PROTEOGLYCAN CORE PROTEIN PRECURSOR (HSPG) (PERLECAN) (PLC).//5.90E-65//238aa//32%//Q05793
PLACE60118810//*Rattus norvegicus* kinesin light chain KLCt mRNA, complete cds.//1.90E-230//504aa//87%//AF166267
PLACE60119700//*Homo sapiens* mRNA for ABP32, complete cds.//2.30E-21//47aa//100%//AB018357
PLACE60120280//SER/THR-RICH PROTEIN T10 IN DGCR REGION.//6.00E-99//126aa//84%//P54797
PLACE60122970//novel C2H2 type zinc finger protein//5.60E-84//169aa//98%//CAC10457
PLACE60132200//TRICHOHYALIN.//3.10E-47//297aa//47%//P37709
PLACE60132320
PLACE60132880
PLACE60138840//PUTATIVE MITOCHONDRIAL CARRIER PROTEIN PET8.//7.40E-59//274aa//47%//P38921
PLACE60140640//*Homo sapiens* nucleotide binding protein (NBP) mRNA, complete cds.//3.90E-138//262aa//99%//AF208536
PLACE60150510//NUCLEAR PROTEIN SNF7.//1.60E-11//189aa//25%//P39929
PLACE60154450//PUTATIVE PREOPTIC REGULATORY FACTOR-2 PRECURSOR (PORF-2).//7.30E-36//75aa//98%//P18890
PLACE60155910
PLACE60157310
PLACE60162100
PLACE60175640
PLACE60177880//IGSF5 [*Homo sapiens*].//3.60E-174//315aa//99%//CAB90447
PLACE60177910
PLACE60181870
PLACE60184410//*Mus musculus* peroxisomal long chain acyl-CoA thioesterase Ib (Pte1b) gene, exon 3 and complete cds.//1.00E-43//126aa//69%//AF180801
PLACE60184870//PHOSPHOLIPID TRANSFER PROTEIN PRECURSOR (LIPID TRANSFER PROTEIN II).//1.50E-227//330aa//99%//P55058
PLACE60188630//*Mus musculus* mRNA for acetylglucosaminyltransferase-like protein.//7.80E-08//317aa//23%//AJ006278
PROST10001100//*Zea mays* clone AGPZm1 arabinogalactan protein (agp) mRNA, partial cds.//5.80E-05//180aa//32%//AF134579
PROST10001360
PROST10002150
PROST20007170//Hypothetical Kruppel-Type Zinc Finger Protein(R28830_1)//0//432aa//100%//AAC24608
PROST20007600//PUTATIVE ENDONUCLEASE C1F12.06C (EC 3.1.-.-).//5.90E-29//134aa//44%//Q10348
PROST20011160
PROST20011800
PROST20014140
PROST20014150
PROST20014650
PROST20015210//MYOSIN HEAVY CHAIN, SMOOTH MUSCLE ISOFORM (SMMHC) (FRAGMENT).//3.00E-107//262aa//85%//P35749
PROST20015400
PROST20016760//M-PHASE PHOSPHOPROTEIN 8 (FRAGMENT).//9.00E-157//298aa//99%//Q99549
PROST20022120
PROST20024250//ZINC FINGER PROTEIN 136.//1.70E-45//128aa//63%//P52737
PROST20028970//*Oryctolagus cuniculus* CARP mRNA, complete cds.//4.80E-44//177aa//51%//AF131883
PROST20033240//EPHRIN TYPE-A RECEPTOR 6 PRECURSOR (EC 2.7.1.112) (TYROSINE-PROTEIN KINASE RECEPTOR EHK-2) (EPH HOMOLOGY KINASE-2).//8.40E-241//441aa//95%//Q62413
PROST20035170//*Homo sapiens* zinc finger protein dp mRNA, complete cds.//3.40E-15//128aa//42%//AF153201
PROST20035830
PROST20036280
PROST20036350//MULTIFUNCTIONAL AMINOACYL-TRNA SYNTHETASE [INCLUDES: GLUTAMYL-TRNA SYNTHETASE (EC 6.1.1.17) (GLUTAMATE—TRNA LIGASE); PROLYL-TRNA SYNTHETASE (EC 6.1.1.15) (PROLINE—TRNA LIGASE)].//2.20E-137//651aa//42%//P07814
PROST20039300//*Bos taurus* mitochondrial mRNA for xenobiotic/medium-chain fatty acid:CoA ligase form XL-III.//1.60E-68//180aa//68%//AJ132751
PROST20041460

PROST20042700
PROST20045700//*Zea mays* clone AGPZm1 arabinogalactan protein (agp) mRNA, partial cds.//5.80E−05//180aa//32%//AF134579
PROST20047440
PROST20048170
PROST20050390//CYTOCHROME P450 2J2 (EC 1.14.14.1) (CYPIIJ2) (ARACHIDONIC ACID EPOXYGENASE).//1.40E−34//188aa//42%//P51589
PROST20051310//*Homo sapiens* DEAD-box protein abstrakt (ABS) mRNA, complete cds.//8.50E−134//257aa//99%//AF195417
PROST20052720
PROST20052850//CYCLIN G-ASSOCIATED KINASE (EC 2.7.1.-).//2.20E−18//107aa//54%//P97874
PROST20054660
PROST20058860//SMALL NUCLEAR RIBONUCLEOPROTEIN ASSOCIATED PROTEINS B AND B' (SNRNP-B) (SM PROTEIN B/B') (SM-B/SM-B').//8.20E−05//134aa//33%//P14678
PROST20060200
PROST20062820//TRANSLATION INITIATION FACTOR IF-2.//1.50E−07//102aa//41%//P71613
PROST20063430//BCL2/ADENOVIRUS E1B 19-KDA PROTEIN-INTERACTING PROTEIN 2.//8.50E−74//305aa//46%//Q12982
PROST20065100
PROST20065790//6-PHOSPHOFRUCTOKINASE, TYPE C (EC 2.7.1.11) (PHOSPHOFRUCTOKINASE 1) (PHOSPHOHEXOKINASE) (PHOSPHOFRUCTO-1-KINASE ISOZYME C) (6-PHOSPHOFRUCTOKINASE, PLATELET TYPE).//0//697aa//99%//Q01813
PROST20073280
PROST20075280//MYOSIN LIGHT CHAIN KINASE, SMOOTH MUSCLE AND NON-MUSCLE ISOZYMES (EC 2.7.1.117) (MLCK) [CONTAINS: TELOKIN].//1.30E−08//245aa//23%//P11799
PROST20078710
PROST20082430
PROST20084470//*Plasmodium berghei* strain NYU2 merozoite surface protein-1 mRNA, partial cds.//2.50E−08//122aa//28%//AF000413
PROST20084680
PROST20084720//CYTOCHROME P450 4F2 (EC 1.14.13.30) (CYPIVF2) (LEUKOTRIENE-B4 OMEGA-HYDROXYLASE) (LEUKOTRIENE-B4 20-MONOOXYGENASE) (CYTOCHROME P450-LTB-OMEGA).//1.50E−37//85aa//85%//P78329
PROST20087240
PROST20093470
PROST20094000
PROST20097310
PROST20097360
PROST20097840//SYNAPSIN I.//1.80E−09//193aa//34%//P17599
PROST20099090//ADAM 12 PRECURSOR (EC 3.4.24.-) (A DISINTEGRIN AND METALLOPROTEINASE DOMAIN 12) (MELTRIN ALPHA).//1.90E−22//73aa//60%//O43184
PROST20102190//CALMODULIN.//1.30E−20//98aa//47%//P02594
PROST20102500
PROST20103820
PROST20105450//SODIUM/HYDROGEN EXCHANGER 6 (NA(+)/H(+) EXCHANGER 6) (NHE-6) (KIAA0267).//1.60E−96//214aa//75%//Q92581
PROST20106060
PROST20108850//MICROSOMAL SIGNAL PEPTIDASE 23 KDA SUBUNIT (EC 3.4.-.-) (SPC22/23).//1.20E−69//132aa//100%//P12280
PROST20110120
PROST20114100
PROST20120070//KINESIN HEAVY CHAIN (UBIQUITOUS KINESIN HEAVY CHAIN) (UKHC).//5.00E−05//286aa//24%//P33176
PROST20121570
PROST20122490//*Gallus gallus* syndesmos mRNA, complete cds.//1.20E−63//139aa//84%//AF095446
PROST20124000
PROST20125420
PROST20127450//*Homo sapiens* TSC-22 related protein (TSC-22R) mRNA, complete cds.//7.90E−44//95aa//98%//AF153603
PROST20130320
PROST20138730
PROST20146590//MUCIN 1 PRECURSOR (POLYMORPHIC EPITHELIAL MUCIN) (PEM) (PEMT) (EPISIALIN) (TUMOR-ASSOCIATED MUCIN) (CARCINOMA-ASSOCIATED MUCIN) (TUMOR-ASSOCIATED EPITHELIAL MEMBRANE ANTIGEN) (EMA) (H23AG) (PEANUT-REACTIVE URINARY MUCIN) (PUM) (BREAST CARCINOMA-ASSOCIATED ANTIGEN DF3).//3.50E−08//556aa//23%//P15941
PROST20151370//Human probable zinc finger protein H101 mRNA, partial cds.//1.60E−11//104aa//41%//U81557
PROST20152510//UDP-N-ACETYLGLUCOSAMINE—PEPTIDE N-ACETYLGLUCOSAMINYLTRANSFERASE 100 KDA SUBUNIT (EC 2.4.1.-) (0-GLCNAC TRANSFERASE P100 SUBUNIT).//6.00E−17//148aa//34%//015294
PROST20152870//*Homo sapiens* APC2 gene, exon 14.//1.60E−05//195aa//30%//AJ131187
PROST20155370//ZINC FINGER PROTEIN 38 (ZFP-38) (CTFIN51) (TRANSCRIPTION FACTOR RU49).//1.10E−72//140aa//55%//Q07231
PROST20156360
PROST20159320
PROST20168600//*Homo sapiens* six transmembrane epithelial antigen of prostate (STEAP1) mRNA, complete cds.//1.20E−70//237aa//54%//AF186249
PUAEN10000650//*Homo sapiens* TSC-22 related protein (TSC-22R) mRNA, complete cds.//7.90E−44//95aa//98%//AF153603
PUAEN10000870
PUAEN10001640//*Mus musculus* cerebellar postnatal development protein-1 (Cpd1) mRNA, partial cds.//2.80E−126//270aa//90%//U89345
PUAEN20000800
PUAEN20001520//L-A VIRUS GAG PROTEIN N-ACETYLTRANSFERASE (EC 2.3.1.-).//1.70E−34//145aa//51%//Q03503
PUAEN20002470//PROTEIN MOV-10.//6.30E−102//405aa//44%//P23249
PUAEN20003120//ENHANCER OF ZESTE HOMOLOG 2 (ENX-1).//0//643aa//97%//Q15910
SALGL10001070//CH-TOG PROTEIN (COLONIC AND HEPATIC TUMOR OVER-EXPRESSED PROTEIN) (KIAA0097).//5.30E−150//297aa//96%//Q14008
SKMUS20006790
SKMUS20007260//MICROTUBULE-ASSOCIATED PROTEIN 1B (MAP1.2) (MAP1(X)) [CONTAINS: MAP1 LIGHT CHAIN LC1].//8.10E−05//396aa//23%//P14873

SKMUS20008730//smoothelin large isoform L2 [*Homo sapiens*].//1.20E-221//217aa//98%//AAF01481
SKMUS20017400//TROPOMYOSIN ALPHA CHAIN, SKELETAL MUSCLE TYPE.//3.20E-97//242aa//81%//P06753
SKMUS20020770
SKMUS20026340
SKMUS20040440//60S RIBOSOMAL PROTEIN L3 (HIV-1 TAR RNA BINDING PROTEIN B) (TARBP-B).//3.60E-189//229aa//99%//P39023
SKMUS20064810
SKMUS20073150//20-HYDROXYECDYSONE PROTEIN PRECURSOR (20-HE).//1.50E-05//129aa//32%//P29681
SKMUS20073590//tropomodulin 4 (muscle) [*Homo sapiens*]//3.90E-58//115aa//100%//NP_037485
SKMUS20079150//splicing factor 3a, subunit 3, 60 kD; pre-mRNA splicing factor SF3a (60 kD), similar to *S. cerevisiae* PRP9 (spliceosome-associated protein 61) [*Homo sapiens*]//9.10E-13//65aa//60%//NP_006793
SKMUS20091900
SKNMC10001230//CYCLIN-DEPENDENT KINASE 4 INHIBITOR A (CDK4I) (P16-INK4) (P16-INK4A) (TUMOR SUPPRESSOR CDKN2A).//1.60E-08//105aa//38%//O77617
SKNMC20006350//65 KDA FK506-BINDING PROTEIN PRECURSOR (EC 5.2.1.8) (FKBP65) (FKBPRP) (PEPTIDYL-PROLYL CIS-TRANS ISOMERASE) (PPIASE) (ROTAMASE) (IMMUNOPHILIN FKBP65).//1.10E-185//419aa//79%//Q61576
SKNSH10001010
SKNSH20007160
SKNSH20009710//TROPOMYOSIN, CYTOSKELETAL TYPE (TM30-NM).//3.20E-74//174aa//86%//P12324
SKNSH20030640//SPLICEOSOME ASSOCIATED PROTEIN 62 (SAP 62) (SF3A66).//3.00E-06//127aa//33%//Q62203
SKNSH20040390
SKNSH20052400//VEGETATIBLE INCOMPATIBILITY PROTEIN HET-E-1.//3.60E-17//175aa//29%//Q00808
SKNSH20057920//CALCIUM/CALMODULIN-DEPENDENT PROTEIN KINASE TYPE I (EC 2.7.1.123) (CAM KINASE I).//5.00E-37//197aa//40%//Q14012
SKNSH20068220
SKNSH20094350
SMINT20000070//*Mus musculus* mRNA for granuphilin-b, complete cds.//2.70E-44//128aa//41%//AB025259
SMINT20002320//SERINE/THREONINE PROTEIN PHOSPHATASE 2A, 56 KDA REGULATORY SUBUNIT, BETA ISOFORM (PP2A, B SUBUNIT, B' BETA ISOFORM) (PP2A, B SUBUNIT, B56 BETA ISOFORM) (PP2A, B SUBUNIT, PR61 BETA ISOFORM) (PP2A, B SUBUNIT, R5 BETA ISOFORM).//4.70E-160//299aa//100%//Q15173
SMINT20006020//faciogenital dysplasia protein 2 [*Mus musculus*]//4.10E-158//327aa//87%//AF017368
SMINT20006090//*Oryctolagus cuniculus* mRNA for parchorin, complete cds.//7.50E-87//175aa//93%//AB035520
SMINT20007470//TRICHOHYALIN.//1.20E-37//492aa//28%//Q07283
SMINT20008110//CALCIUM-TRANSPORTING ATPASE 2C1 (EC 3.6.1.38) (ATP-DEPENDENT CA2+PUMP PMR1).//1.20E-50//165aa//63%//P98194
SMINT20011830
SMINT20011950//ZINC FINGER PROTEIN 202.//1.90E-67//426aa//40%//O95125
SMINT20012220
SMINT20013970
SMINT20014610
SMINT20016150//FERRITIN LIGHT CHAIN (FERRITIN L SUBUNIT).//3.50E-91//174aa//100%//P02792
SMINT20017310
SMINT20021260
SMINT20023110
SMINT20024140//IG KAPPA CHAIN V-IV REGION B17 PRECURSOR.//1.20E-60//134aa//87%//P06314
SMINT20026200//ENL PROTEIN.//1.10E-05//260aa//24%//Q03111
SMINT20028800//tumor supressor protein—fruit fly (*Drosophila melanogaster*).//2.00E-78//493aa//34%//T13797
SMINT20028840//CMRF35 ANTIGEN PRECURSOR.//8.40E-19//136aa//41%//Q08708
SMINT20030740//ZINC FINGER PROTEIN 136.//4.50E-194//535aa//63%//P52737
SMINT20031280
SMINT20035050//GTPASE ACTIVATING PROTEIN BEM2/IPL2.//1.20E-07//134aa//26%//P39960
SMINT20035510//*Drosophila melanogaster* La related protein (larp) mRNA, partial cds.//5.40E-39//334aa//30%//AF221108
SMINT20036440//*Drosophila melanogaster* epsin-like protein mRNA, complete cds.//2.90E-69//446aa//41%//AF233291
SMINT20038660//*Homo sapiens* HNOEL-iso (HNOEL-iso) mRNA, complete cds.//5.60E-201//368aa//99%//AF201945
SMINT20039050//*Homo sapiens* TRIAD3 mRNA, partial cds.//3.20E-86//156aa//100%//AF228527
SMINT20043390
SMINT20044140//ZINC FINGER PROTEIN 84 (ZINC FINGER PROTEIN HPF2).//3.50E-39//440aa//28%//P51523
SMINT20044730//UBIQUINONE BIOSYNTHESIS PROTEIN AARF.//6.20E-22//272aa//27%//P27854
SMINT20045470
SMINT20045830
SMINT20045890
SMINT20047290
SMINT20048720
SMINT20049920//CYTOSOLIC PURINE 5'-NUCLEOTIDASE (EC 3.1.3.5).//4.10E-39//132aa//57%//P49902
SMINT20052130//*Rattus norvegicus* mRNA for gankyrin homologue, complete cds.//9.20E-07//104aa//33%//AB022014
SMINT20054050//ABC1 PROTEIN HOMOLOG PRECURSOR.//1.40E-98//467aa//45%//Q92338
SMINT20056230//Ig mu chain precursor, membrane-bound (clone 201)—human//5.60E-233//422aa//78%//S14683
SMINT20056240
SMINT20062050//PLECTIN.//7.50E-17//436aa//25%//P30427
SMINT20067080
SMINT20070620
SMINT20074330//tektin A1 [*Strongylocentrotus purpuratus*]//3.10E-26//125aa//45%//M97188
SMINT20077920
SMINT20077960//GELSOLIN PRECURSOR, PLASMA (ACTIN-DEPOLYMERIZING FACTOR) (ADF) (BREVIN) (AGEL).//3.30E-246//459aa//99%//P06396
SMINT20081330
SMINT20083290//IG ALPHA-1 CHAIN C REGION.//4.40E-196//352aa//99%//P01876

SMINT20084910
SMINT20085310
SMINT20085450
SMINT20086250//GLYCINE CLEAVAGE SYSTEM H PROTEIN PRECURSOR.//2.20E−40//70aa//97%//P23434
SMINT20086720//ZINC FINGER PROTEIN 191.//1.40E−29//109aa//55%//O14754
SMINT20088440//IG KAPPA CHAIN V-II REGION RPMI 6410 PRECURSOR.//5.10E−44//117aa//78%//P06310
SMINT20088690
SMINT20089210
SMINT20089600//*Homo sapiens* mRNA for PICK1, complete cds.//3.10E−145//278aa//100%//AB026491
SMINT20091190//IG ALPHA-1 CHAIN C REGION.//3.70E−198//353aa//99%//P01876
SMINT20092120
SMINT20092160
SMINT20093630
SMINT20094150
SMINT20094680//*Homo sapiens* mawbp mRNA for MAWD binding protein, complete cds.//2.80E−50//77aa//100%//AB049758
SPLEN20005160
SPLEN20005370
SPLEN20006950
SPLEN20011350
SPLEN20012450
SPLEN20015030
SPLEN20015100//HYPOTHETICAL 72.5 KDA PROTEIN C2F7.10 IN CHROMOSOME I.//7.50E−16//121aa//36%//Q09701
SPLEN20016500
SPLEN20017610
SPLEN20017810
SPLEN20019120
SPLEN20020530
SPLEN20023430
SPLEN20023540//*H.sapiens* mRNA for F25B3.3 kinase like protein from *C.elegans*.//1.50E−205//385aa//99%//Y12336
SPLEN20023850//DNA REPAIR PROTEIN RAD18.//3.00E−56//469aa//30%//P53692
SPLEN20024190//EGF-containing fibulin-like extracellular matrix protein 1; fibrillin-like [*Homo sapiens*]//3.70E−192//327aa//99%//NP_061489
SPLEN20024510
SPLEN20024620//*Homo sapiens* mRNA for acetyl LDL receptor, complete cds.//1.00E−217//401aa//100%//D86864
SPLEN20024770//*Rattus norvegicus* (rsec6) mRNA, complete cds.//2.10E−88//545aa//31%//U32575
SPLEN20024930//*Rattus norvegicus* PIPP mRNA for proline-rich inositol polyphosphate 5-phosphatase, complete cds.//0//639aa//91%//AB032551
SPLEN20029170
SPLEN20036780
SPLEN20039180//TENSIN.//2.70E−135//341aa//65%//Q04205
SPLEN20040780//CORNIFIN B (SMALL PROLINE-RICH PROTEIN 1B) (SPR1B) (SPR1 B).//5.10E−12//110aa//37%//Q62267
SPLEN20041810//BC-2 protein [*Homo sapiens*]//4.00E−24//59aa//96%//AF042384
SPLEN20042200//TRANSCRIPTIONAL REPRESSOR CTCF.//8.40E−22//127aa//33%//P49711
SPLEN20043430
SPLEN20043460
SPLEN20043680//DNA-REPAIR PROTEIN COMPLEMENTING XP-D CELLS (XERODERMA PIGMENTOSUM GROUP D COMPLEMENTING PROTEIN) (DNA EXCISION REPAIR PROTEIN ERCC-2).//7.30E−171//325aa//99%//P18074
SPLEN20045550
SPLEN20048800//*Homo sapiens* mRNA for N-Acetylglucosamine kinase.//1.90E−51//104aa//100%//AJ242910
SPLEN20049840//*M. musculus* mRNA for myosin I.//0//1093aa//89%//X97650
SPLEN20050090//TRICHOHYALIN.//7.20E−17//554aa//23%//P37709
SPLEN20051420
SPLEN20054160//Dof protein [*Drosophila melanogaster*]//9.60E−14//222aa//29%//AJ010641
SPLEN20054500//*Homo sapiens* mRNA for putative dipeptidase.//7.10E−130//244aa//100%//AJ295149
SPLEN20055600//ZINC FINGER PROTEIN 46 (ZINC FINGER PROTEIN KUP).//3.00E−56//155aa//63%//P24278
SPLEN20057830//REGULATOR OF MITOTIC SPINDLE ASSEMBLY 1 (RMSA-1).//1.10E−16//139aa//43%//P49646
SPLEN20057900//*Homo sapiens* N-acetylglucosamine-1-phosphodiester alpha-N-acetylglucosaminidase mRNA, complete cds.//9.00E−75//130aa//93%//AF187072
SPLEN20058180
SPLEN20059270//ZINC-FINGER PROTEIN RFP (RET FINGER PROTEIN).//7.20E−61//497aa//31%//P14373
SPLEN20062830
SPLEN20063250//zinc finger protein nocA—fruit fly (*Drosophila melanogaster*)//9.00E−16//364aa//30%//A55929
SPLEN20063890//FIBROMODULIN PRECURSOR (FM) (COLLAGEN-BINDING 59 KDA PROTEIN).//2.60E−118//242aa//94%//Q06828
SPLEN20067010
SPLEN20071820//*Homo sapiens* DNA polymerase mu (Pol mu) mRNA, complete cds.//4.70E−62//116aa//100%//AF176097
SPLEN20073500//TUMOR NECROSIS FACTOR, ALPHA-INDUCED PROTEIN 2 (B94 PROTEIN).//3.50E−10//463aa//25%//Q03169
SPLEN20073880
SPLEN20076190
SPLEN20076470//KINESIN LIGHT CHAIN (KLC).//2.40E−18//137aa//38%//P46825
SPLEN20080070//TISSUE ALPHA-L-FUCOSIDASE PRECURSOR (EC 3.2.1.51) (ALPHA-L-FUCOSIDASE I) (ALPHA-L-FUCOSIDE FUCOHYDROLASE).//4.70E−253//359aa//98%//P04066
SPLEN20081640
SPLEN20085910//*Homo sapiens* protein activator of the interferon-induced protein kinase (PACT) mRNA, complete cds.//2.90E−23//52aa//100%//AF072860
SPLEN20087370
SPLEN20087860
SPLEN20090880//HLA CLASS I HISTOCOMPATIBILITY ANTIGEN, A-24(A-9) ALPHA CHAIN PRECURSOR (AW-24).//1.40E−66//153aa//83%//P05534
SPLEN20098030//TRANSCRIPTION INTERMEDIARY FACTOR 1-BETA (NUCLEAR COREPRESSOR KAP-1) (KRAB-ASSOCIATED PROTEIN 1).//4.00E−18//267aa//26%//Q13263
SPLEN20100040//258.1 KDA PROTEIN C21ORF5 (KIAA0933).//7.90E−46//223aa//43%//Q9Y3R5

SPLEN20101950//SODIUM/HYDROGEN EXCHANGER 6 (NA(+)/H(+) EXCHANGER 6) (NHE-6) (KIAA0267).//7.70E–112//353aa//61%//Q92581
SPLEN20104150
SPLEN20104690
SPLEN20105100
SPLEN20108000//*Homo sapiens* steroid dehydrogenase homolog mRNA, complete cds.//9.30E–73//155aa//94%//AF078850
SPLEN20108460
SPLEN20110180//*Homo sapiens* golgi membrane protein GP73 mRNA, complete cds.//1.60E–162//347aa//91%//AF236056
SPLEN20110210
SPLEN20110860
SPLEN20111450
SPLEN20114190
SPLEN20116720//*Homo sapiens* misato mRNA, partial cds.//1.00E–277//481aa//89%//AF272833
SPLEN20117580
SPLEN20118050//BONE/CARTILAGE PROTEOGLYCAN I PRECURSOR (BIGLYCAN) (PG-S1).//1.00E123//240aa//97%//P21810
SPLEN20121790
SPLEN20125230
SPLEN20126110
SPLEN20135030//*Homo sapiens* PDZ-LIM protein mystique mRNA, complete cds.//3.30E–92//178aa//97%//AY007729
SPLEN20136700
SPLEN20136730//*Homo sapiens* RAB-like protein 2A (RABL2A) mRNA, complete cds.//9.30E–41//102aa//90%//AF095350
SPLEN20137530
SPLEN20138600//NUMB protein [*Homo sapiens*].//1.00E–97//102aa//100%//AAD01548
SPLEN20139100//Human (hybridoma H210) anti-hepatitis A IgG variable region, constant region, complementarity-determining regions mRNA, complete cds.//2.30E–227//490aa//85%//M87789
SPLEN20139360//MAJOR CENTROMERE AUTOANTIGEN B (CENTROMERE PROTEIN B) (CENP-B).//5.10E–35//295aa//32%//P07199
SPLEN20175920
SPLEN20176130//*Homo sapiens* mRNA for ALEX1, complete cds.//9.90E–21//161aa//32%//AB039670
SPLEN20177400
SPLEN20180980//METHIONYL-TRNA SYNTHETASE (EC 6.1.1.10) (METHIONINE—TRNA LIGASE) (METRS).//3.40E–57//133aa//87%//P56192
SPLEN20181570//TRICHOHYALIN.//7.80E–45//832aa//23%//P37709
SPLEN20182850
SPLEN20182990//*Mus musculus* actin-binding protein (ENC-1) mRNA, complete cds.//1.90E–49//586aa//26%//U65079
SPLEN20183020//BASEMENT MEMBRANE-SPECIFIC HEPARAN SULFATE PROTEOGLYCAN CORE PROTEIN PRECURSOR (HSPG) (PERLECAN) (PLC).//1.20E–24//128aa//46%//Q05793
SPLEN20183950
SPLEN20187490//RESTIN (CYTOPLASMIC LINKER PROTEIN-170 ALPHA-2) (CLIP-170) (REED-STERNBERG INTERMEDIATE FILAMENT ASSOCIATED PROTEIN).//5.10E–09//411aa//22%//P30622
SPLEN20190080
SPLEN20190430//NEURALIZED PROTEIN.//2.80E–09//181aa//27%//P29503
SPLEN20190770
SPLEN20191020//*Homo sapiens* MIST mRNA, partial cds.//1.50E–207//376aa//99%//AB032369
SPLEN20192570
SPLEN20193230
SPLEN20193490
SPLEN20193750
SPLEN20193790//INTERFERON-REGULATED RESISTANCE GTP-BINDING PROTEIN MXA (INTERFERON- INDUCED PROTEIN P78) (IFI-78K).//0//572aa//98%//P20591
SPLEN20195710//KINESIN LIGHT CHAIN (KLC).//5.80E–28//145aa//45%//P46824
SPLEN20197090
SPLEN20197740
SPLEN20197930//*Rattus norvegicus* putative transcription factor LUZP (Luzp) mRNA, complete cds.//6.10E–124//275aa//90%//AF181259
SPLEN20198390//TIPD PROTEIN.//2.80E–52//307aa//37%//O15736
SPLEN20199850
SPLEN20200070
SPLEN20200340
SPLEN20201830//BONE/CARTILAGE PROTEOGLYCAN I PRECURSOR (BIGLYCAN) (PG-S1).//2.50E152//283aa//100%//P21810
SPLEN20203590
SPLEN20204670
SPLEN20205120
TESOP10000350
TESOP10001600
TESTI10000190//MUCIN 1 PRECURSOR (POLYMORPHIC EPITHELIAL MUCIN) (PEM) (PEMT) (EPISIALIN) (TUMOR-ASSOCIATED MUCIN) (CARCINOMA-ASSOCIATED MUCIN) (TUMOR-ASSOCIATED EPITHELIAL MEMBRANE ANTIGEN) (EMA) (H23AG) (PEANUT- REACTIVE URINARY MUCIN) (PUM) (BREAST CARCINOMA-ASSOCIATED ANTIGEN DF3).//1.40E–23//667aa//28%//P15941
TESTI10000850
TESTI10001570//ZINC FINGER PROTEIN 84 (ZINC FINGER PROTEIN HPF2).//1.30E–148//598aa//46%//P51523
TESTI20004310//TRICHOHYALIN.//1.40E–07//247aa//25%//P22793
TESTI20005980
TESTI20006160//CALCIUM-BINDING PROTEIN.//1.10E–11//260aa//28%//P35085
TESTI20006830//GAR2 PROTEIN.//2.90E–05//221aa//19%//P41891
TESTI20012080//TUBULIN—TYROSINE LIGASE (EC 6.3.2.25) (TTL).//2.20E–22//217aa//35%//P38584
TESTI20012360
TESTI20016970
TESTI20019590
TESTI20028020
TESTI20029100//FIBROSIN (FRAGMENT).//1.60E–10//70aa//48%//Q60791
TESTI20030200//DOUBLE-STRANDED RNA-SPECIFIC EDITASE 1 (EC 3.5.-.-) (DSRNA ADENOSINE DEAMINASE) (RNA EDITING ENZYME 1).//1.90E–30//192aa//38%//P51400
TESTI20030440//TRICHOHYALIN.//2.80E–21//412aa//26%//P37709
TESTI20030610
TESTI20031310//ALPHA-1-ANTICHYMOTRYPSIN PRECURSOR (ACT).//7.80E–222//423aa//99%//P01011

TESTI20031410//SYNAPTONEMAL COMPLEX PROTEIN 1 (SCP-1 PROTEIN).//6.10E–11//449aa//24%//Q03410
TESTI20032770//ANTER-SPECIFIC PROLINE-RICH PROTEIN APG PRECURSOR.//1.40E–07//121aa//37%//P40602
TESTI20034750
TESTI20035330
TESTI20035790//SPLICING FACTOR, ARGININE/SERINE-RICH 4 (PRE-MRNA SPLICING FACTOR SRP75).//2.30E–44//346aa//37%//Q08170
TESTI20038240//*Mus musculus* neprilysin-like metallopeptidase 1 (N11) mRNA, complete cds.//0//770aa//77%//AF176569
TESTI20040850
TESTI20041630//*Mus musculus* mRNA for type II cytokeratin, complete cds.//1.30E–151//407aa//75%//AB033744
TESTI20043130
TESTI20043180//mouse mRNA for megakaryocyte potentiating factor, complete cds.//8.40E–06//392aa//24%//D86370
TESTI20043220//ORM1 PROTEIN.//6.40E–21//138aa//37%//P53224
TESTI20043910
TESTI20043990//APOMUCIN (MUCIN CORE PROTEIN) (FRAGMENT).//8.70E–64//283aa//53%//P12021
TESTI20044900//*Strongylocentrotus purpuratus* radial spokehead mRNA, complete cds.//2.50E–150//447aa//61%//U73123
TESTI20045390//*Homo sapiens* adlican mRNA, complete cds.//1.80E–173//632aa//47%//AF245505
TESTI20045740
TESTI20046110
TESTI20046490//*Homo sapiens* B2 gene partial cDNA, clone B2E.//4.30E–33//284aa//34%//AJ002220
TESTI20046540
TESTI20046870//RETINAL-BINDING PROTEIN (RALBP).//4.00E–06//244aa//23%//P49193
TESTI20046890//*Mus musculus* axotrophin mRNA, complete cds.//2.30E–40//173aa//53%//AF155739
TESTI20047370//ATROPHIN-1 (DENTATORUBRAL-PALLIDOLUYSIAN ATROPHY PROTEIN).//1.90E–22//695aa//28%//P54258
TESTI20047930//*Homo sapiens* NY-REN-2 antigen mRNA, complete cds.//1.50E–191//530aa//67%//AF155095
TESTI20049060//*H. sapiens* mRNA for SIRP-beta1.//2.50E–31//172aa//45%//Y10376
TESTI20049410
TESTI20049990
TESTI20050170
TESTI20050400
TESTI20050720//SUCCINYL-COA:3-KETOACID-COENZYME A TRANSFERASE PRECURSOR (EC 2.8.3.5) (SUCCINYL COA:3-OXOACID COA-TRANSFERASE) (OXCT).//1.40E–208//519aa//74%//P55809
TESTI20051200//POLYPEPTIDE N-ACETYLGALACTOSAMINYLTRANSFERASE (EC 2.4.1.41) (PROTEIN-UDP ACETYLGALACTOSAMINYLTRANSFERASE) (UDP-GALNAC:POLYPEPTIDE, N-ACETYLGALACTOSAMINYLTRANSFERASE) (GALNAC-T1).//6.10E–50//189aa//49%//Q10472
TESTI20051730//MALTOSE PERMEASE.//2.20E–05//327aa//23%//Q45632
TESTI20052670
TESTI20053070//HYPOTHETICAL WD-REPEAT PROTEIN SLL0163.//5.00E–06//172aa//28%//Q55563
TESTI20053260
TESTI20053780
TESTI20053800
TESTI20053950
TESTI20054700//*Streptococcus pneumoniae* strain g375 surface protein PspC (pspC) gene, pspC-8.1 allele, complete cds.//6.70E–11//219aa//32%//AF154015
TESTI20055680//TRANSLATION INITIATION FACTOR IF-2.//5.90E–08//98aa//41%//O60841
TESTI20055880
TESTI20056030//*Homo sapiens* 88-kDa Golgi protein (GM88) mRNA, complete cds.//3.60E–103//316aa//68%//AF204231
TESTI20057200
TESTI20057430//ZINC FINGER PROTEIN 8 (ZINC FINGER PROTEIN HF.18) (FRAGMENT).//3.00E–307//543aa//99%//P17098
TESTI20057590//TYROSINE-PROTEIN KINASE-LIKE 7 PRECURSOR (COLON CARCINOMA KINASE-4) (CCK-4).//7.80E–07//152aa//27%//Q13308
TESTI20057840//INHIBITOR OF APOPTOSIS PROTEIN (IAP) (INHIBITOR OF T CELL APOPTOSIS PROTEIN).//7.20E–08//86aa//36%//Q90660
TESTI20057880//CALDESMON (CDM).//6.20E–08//203aa//29%//P12957
TESTI20058350//SERINE/THREONINE PROTEIN PHOSPHATASE 2A, 55 KDA REGULATORY SUBUNIT B, GAMMA ISOFORM (PP2A, SUBUNIT B, B-GAMMA ISOFORM) (PP2A, SUBUNIT B, B55-GAMMA ISOFORM) (PP2A, SUBUNIT B, PR55-GAMMA ISOFORM) (PP2A, SUBUNIT B, R2-GAMMA ISOFORM).//2.00E–232//426aa//99%//P50410
TESTI20058920//TUBULIN ALPHA-3/ALPHA-7 CHAIN.//3.50E–148//277aa//98%//P05214
TESTI20059080//*Homo sapiens* hyaluronidase (LUCA-3) mRNA, complete cds.//2.40E–170//298aa//100%//AF040710
TESTI20059330
TESTI20059370
TESTI20059480
TESTI20059790
TESTI20059810//ZINC FINGER PROTEIN 84 (ZINC FINGER PROTEIN HPF2).//7.50E–153//536aa//52%//P51523
TESTI20060080//MYOSIN HEAVY CHAIN, CLONE 203 (FRAGMENT).//5.30E–09//236aa//24%//P39922
TESTI20060150
TESTI20060350
TESTI20060450
TESTI20060830//*Mus musculus* mRNA for MIWI (piwi), complete cds.//0//824aa//94%//AB032604
TESTI20061090
TESTI20061200//NITRITE EXTRUSION PROTEIN (NITRITE FACILITATOR).//4.90E–05//379aa//23%//P46907
TESTI20062120//poly(A)-specific ribonuclease (deadenylation nuclease); deadenylation nuclease [*Homo sapiens*]//1.00E–38//144aa//36%//NP_002573
TESTI20062180
TESTI20062580
TESTI20063330
TESTI20063410
TESTI20063600

TESTI20064370
TESTI20064530//microtubule-associated protein like echinoderm EMAP [Homo sapiens].//1.00E-173//562aa//48%//XP_009139
TESTI20064650//Rattus norvegicus myr 6 myosin heavy chain mRNA, complete cds.//0//645aa//91%//U60416
TESTI20064990
TESTI20065650//INNER CENTROMERE PROTEIN (INCENP).//1.00E-14//273aa//27%//P53352
TESTI20066150
TESTI20066170
TESTI20066280
TESTI20066330//FIBRONECTIN PRECURSOR.//9.10E-12//408aa//22%//Q91740
TESTI20066590
TESTI20066650//CELL DIVISION CONTROL PROTEIN 25.//2.20E-18//216aa//32%//P04821
TESTI20067350
TESTI20067440//INTRACELLULAR-PROTEIN TRANSPORT PROTEIN US01.//2.90E-11//553aa//20%//P25386
TESTI20067480//ZINC FINGER PROTEIN 184 (FRAGMENT).//8.60E-134//421 aa//50%//Q99676
TESTI20068530
TESTI20068790//TRANS-ACTING TRANSCRIPTIONAL PROTEIN ICP0 (P135 PROTEIN) (IER 2.9/ER2.6).//7.50E-06//240aa//28%//P29128
TESTI20068940
TESTI20070400//Homo sapiens CTL2 gene.//5.90E-229//694aa//55%//AJ245621
TESTI20070740
TESTI20071130//MYOSIN HEAVY CHAIN, CARDIAC MUSCLE ALPHA ISOFORM.//6.30E-09//399aa//23%//Q02566
TESTI20071630//GLIOMA PATHOGENESIS-RELATED PROTEIN (RTVP-1 PROTEIN).//5.10E-44//203aa//42%//P48060
TESTI20073460
TESTI20075240//HYPOTHETICAL ZINC FINGER PROTEIN KIAA0961.//3.20E-145//492aa//56%//Q9Y2G7
TESTI20076570//Homo sapiens mitogen-activated protein kinase phosphatase x (MKPX) mRNA, complete cds.//7.20E-66//126aa//100%//AF165519
TESTI20076920
TESTI20079060
TESTI20079220//ZINC FINGER PROTEIN 29 (ZFP-29).//2.00E-73//281aa//49%//Q07230
TESTI20079980//SEGMENT POLARITY PROTEIN DISHEVELLED HOMOLOG DVL-1 (DISHEVELLED-1) (DSH HOMOLOG 1).//7.10E-212//413aa//93%//P51141
TESTI20080460
TESTI20081890//SPA-1 like protein p1294 [Rattus norvegicus]//5.80E-129//385aa//41%//AF026504
TESTI20083890
TESTI20084250//OXYSTEROL-BINDING PROTEIN.//3.70E-183//551aa//62%//P16258
TESTI20085670
TESTI20086840//CARTILAGE MATRIX PROTEIN PRECURSOR (MATRILIN-1).//3.40E-09//181aa//29%//P05099
TESTI20088840//ZINC-FINGER PROTEIN RFP (RET FINGER PROTEIN).//2.60E-73//258aa//31%//Q62158
TESTI20089290
TESTI20090180
TESTI20090970
TESTI20091360
TESTI20092170
TESTI20093900
TESTI20094620
TESTI20095200//HYPOTHETICAL 98.3 KDA PROTEIN B0495.7 IN CHROMOSOME II.//1.30E-63//328aa//40%//Q09216
TESTI20095440//probable membrane protein YOR240w—yeast (Saccharomyces cerevisiae)//1.00E-25//98aa//55%//S67133
TESTI20095770//NEDD1 PROTEIN (FRAGMENT).//5.80E-297//648aa//85%//P33215
TESTI20095880//HYPOTHETICAL SYMPORTER SLL1374.//3.80E-26//243aa//27%//P74168
TESTI20097270
TESTI20099350//MYOSIN HEAVY CHAIN, NON-MUSCLE TYPE B (CELLULAR MYOSIN HEAVY CHAIN, TYPE B) (NMMHC-B).//1.50E-26//566aa//23%//P35580
TESTI20100090//Homo sapiens endocytic receptor Endo180 (ENDO180) mRNA, complete cds.//5.00E-161//317aa//93%//AF134838
TESTI20102390
TESTI20103690//Columba livia mRNA for 5'-nucleotidase.//2.70E-114//324aa//66%//AJ131243
TESTI20104090//TRANSCRIPTIONAL ENHANCER FACTOR TEF-4 (EMBRYONIC TEA DOMAIN-CONTAINING FACTOR) (ETF) (ETEF-1) (TEAD-2).//1.60E-228//450aa//92%//P48301
TESTI20105130//MYOTUBULARIN.//4.30E-95//537aa//38%//Q13496
TESTI20105910//AMILORIDE-SENSITIVE SODIUM CHANNEL DELTA-SUBUNIT (EPITHELIAL NA+ CHANNEL DELTA SUBUNIT) (DELTA ENAC) (NONVOLTAGE-GATED SODIUM CHANNEL 1 DELTA SUBUNIT) (SCNED) (DELTA NACH).//0//636aa//97%//P51172
TESTI20106170//Mus musculus spermatid WD-repeat protein mRNA, complete cds.//2.20E-167//367aa//83%//AF274321
TESTI20106820//PROTEIN KINASE C, ETA TYPE (EC 2.7.1.-) (NPKC-ETA) (PKC-L).//5.40E-53//97aa//100%//P24723
TESTI20107240//EUKARYOTIC TRANSLATION INITIATION FACTOR 3 SUBUNIT 10 (EIF-3 THETA) (EUKARYOTIC TRANSLATION INITIATION FACTOR 3 LARGE SUBUNIT) (PNLA-35).//5.60E-07//428aa//22%//Q40554
TESTI20107320//G1/S-SPECIFIC CYCLIN C-TYPE.//1.20E-05//130aa//26%//P93411
TESTI20107340
TESTI20108060//SERINE/THREONINE PROTEIN PHOSPHATASE PP1-BETA CATALYTIC SUBUNIT (EC 3.1.3.16) (PP-1B).//1.10E-78//145aa//100%//P37140
TESTI20112540//CALDESMON (CDM).//9.10E-06//203aa//30%//P12957
TESTI20112860//MYOSIN LIGHT CHAIN KINASE (EC 2.7.1.117) (MLCK).//1.60E-54//290aa//40%//P25323
TESTI20113150
TESTI20113940
TESTI20114480//Human 1(3)mbt protein homolog mRNA, complete cds.//7.10E-146//582aa//49%//U89358
TESTI20116050
TESTI20116120//Aegilops squarrosa partial GAG56D gene for gamma-gliadin, accession CIae 24.//3.10E-07//93aa//40%//AJ389681
TESTI20117500
TESTI20118460

TESTI20120500
TESTI20120900
TESTI20121040//PROBABLE PROTEIN PHOSPHATASE 2C T23F11.1 (EC 3.1.3.16) (PP2C).//8.60E–13//91aa//39%//P49596
TESTI20121710//HYPOTHETICAL 57.5 KDA PROTEIN IN VMA7-RPS25A INTERGENIC REGION.//5.00E–08//292aa//26%//P53214
TESTI20122070//*Xenopus laevis* ER1 mRNA, complete cds.//1.80E–78//341aa//49%//AF015454
TESTI20122440
TESTI20124440
TESTI20125280//M-PROTEIN, STRIATED MUSCLE.//3.60E–68//295aa//46%//Q02173
TESTI20125440
TESTI20125920//G PROTEIN PATHWAY SUPPRESSOR 1 (GPS1 PROTEIN) (MFH PROTEIN).//5.20E–199//367aa//98%//Q13098
TESTI20126280//*Mus musculus* STAP mRNA for sperm tail associated protein, complete cds.//4.60E–213//769aa//57%//AB029919
TESTI20130530//INSULIN-DEGRADING ENZYME (EC 3.4.24.56) (INSULYSIN) (INSULINASE) (INSULIN PROTEASE).//1.60E–237//464aa//94%//P14735
TESTI20131440//CARBOXYPEPTIDASE A1 PRECURSOR (EC 3.4.17.1).//2.80E–107//332aa//58%//P15085
TESTI20132310
TESTI20132680
TESTI20134010
TESTI20134270
TESTI20134680//CENTROMERIC PROTEIN E (CENP-E PROTEIN).//2.40E–08//796aa//19%//Q02224
TESTI20134970//*M. musculus* Tenr mRNA for RNA binding protein.//5.50E–265//559aa//88%//X84693
TESTI20136010//MYOSIN HEAVY CHAIN, NON-MUSCLE (CELLULAR MYOSIN HEAVY CHAIN) (NMMHC).//1.10E–11//438aa//23%//P14105
TESTI20140970//V_segment translation product [*Homo sapiens*].//6.30E–51//101aa//99%//AAC80210
TESTI20142480
TESTI20142540//MPV17 PROTEIN.//8.00E–62//116aa//98%//P39210
TESTI20143180//CENTROMERIC PROTEIN E (CENP-E PROTEIN).//3.30E–09//507aa//22%//Q02224
TESTI20144390//TESTIS-SPECIFIC PROTEIN PBS13.//6.40E–76//251aa//63%//Q01755
TESTI20145780//*Mus musculus* mRNA for SH2-containing leukocyte protein 65.//1.20E–13//91aa//36%//Y17159
TESTI20148380//TRANSFORMATION-SENSITIVE PROTEIN IEF SSP 3521.//2.50E–05//193aa//22%//P31948
TESTI20149880
TESTI20150420//RHO-GTPASE-ACTIVATING PROTEIN 1 (GTPASE-ACTIVATING PROTEIN RHOGAP) (RHO-RELATED SMALL GTPASE PROTEIN ACTIVATOR) (CDC42 GTPASE-ACTIVATING PROTEIN) (P50-RHOGAP).//4.50E–09//129aa//34%//Q07960
TESTI20150920//PROTEIN PHOSPHATASES PP1 REGULATORY SUBUNIT SDS22.//2.60E–16//193aa//34%//P22194
TESTI20151050
TESTI20151800
TESTI20152490
TESTI20153310//LAMIN B3.//6.30E–13//104aa//41%//P48680
TESTI20154370//HYALURONAN MEDIATED MOTILITY RECEPTOR (INTRACELLULAR HYALURONIC ACID BINDING PROTEIN) (RECEPTOR FOR HYALURONAN-MEDIATED MOTILITY).//1.10E–07//300aa//21%//075330
TESTI20159380
TESTI20161010
TESTI20162780//COTE1 PROTEIN.//1.00E–107//207aa//99%//P81408
TESTI20162980//DNA-DAMAGE INDUCIBLE PROTEIN DDI1.//1.80E–39//174aa//48%//P40087
TESTI20164210//PROTEIN KINASE-C-BINDING PROTEIN NELL1 (NEL-LIKE PROTEIN 1) (FRAGMENT).//1.60E–88//163aa//92%//Q92832
TESTI20165680
TESTI20165990
TESTI20166290//*Homo sapiens* NY-REN-50 antigen mRNA, partial cds.//3.00E–223//426aa//93%//AF155112
TESTI20166670//HOMEOBOX PROTEIN HOX-B1 (HOX-2I).//6.70E–06//224aa//29%//P14653
TESTI20167580
TESTI20168880//BREAKPOINT CLUSTER REGION PROTEIN (EC 2.7.1.-).//2.10E–23//57aa//92%//P11274
TESTI20169500//HYPOTHETICAL 51.9 KDA PROTEIN C27F1.04C IN CHROMOSOME I.//9.50E–17//428aa//25%//Q10173
TESTI20170170//*Homo sapiens* mRNA for chondroitin-4-sulfotransferase (C4ST gene).//1.10E–53//277aa//40%//AJ269537
TESTI20170280
TESTI20170690
TESTI20170890
TESTI20171070//CYCLIC-AMP-DEPENDENT TRANSCRIPTION FACTOR ATF-4 (DNA-BINDING PROTEIN TAXREB67) (CYCLIC AMP RESPONSE ELEMENT-BINDING PROTEIN 2) (CREB2).//2.60E–63//136aa//91%//P18848
TESTI20173050
TESTI20173110
TESTI20173960//ZINC FINGER PROTEIN 91 (ZINC FINGER PROTEIN HTF10) (HPF7).//1.90E–104//335aa//48%//Q05481
TESTI20175370//MYOSIN HEAVY CHAIN, NON-MUSCLE (CELLULAR MYOSIN HEAVY CHAIN) (NMMHC).//1.00E–11//290aa//25%//P14105
TESTI20176450//thioredoxin interacting factor [*Mus musculus*].//1.00E–75//300aa//46%//AAG32665
TESTI20179230
TESTI20179510
TESTI20180600//*Homo sapiens* HOM-TES-85 tumor antigen mRNA, complete cds.//8.10E–106//202aa//99%//AF124430
TESTI20182210
TESTI20182760//AMILORIDE-SENSITIVE SODIUM CHANNEL DELTA-SUBUNIT (EPITHELIAL NA+ CHANNEL DELTA SUBUNIT) (DELTA ENAC) (NONVOLTAGE-GATED SODIUM CHANNEL 1 DELTA SUBUNIT) (SCNED) (DELTA NACH).//5.90E–185//336aa//99%//P51172
TESTI20183680//EARLY NODULIN 20 PRECURSOR (N-20).//5.10E–08//127aa//37%//P93329
TESTI20184280
TESTI20184750//LAMININ ALPHA-1 CHAIN PRECURSOR (LAMININ A CHAIN).//2.30E–200//377aa//99%//P25391
TESTI20184760//ZINC FINGER PROTEIN 29 (ZFP-29).//9.70E–74//281aa//49%//Q07230
TESTI20184820
TESTI20186110

TESTI20192570
TESTI20193080//GAR22 PROTEIN.//5.10E−153//313aa//92%//Q99501
TESTI20193520
TESTI20194880//PERIOD CIRCADIAN PROTEIN 1 (CIRCADIAN PACEMAKER PROTEIN RIGUI) (HPER).//1.50E−11//288aa//30%//O15534
TESTI20196690//*Bos taurus* pyruvate dehydrogenase phosphatase regulatory subunit precursor, mRNA, complete cds.//9.10E−114//224aa//92%//AF026954
TESTI20196970//THIMET OLIGOPEPTIDASE (EC 3.4.24.15) (ENDOPEPTIDASE 24.15) (MP78).//4.00E−106//147aa//100%//P52888
TESTI20197030
TESTI20197290
TESTI20197600//TRANSCRIPTIONAL REPRESSOR CTCF. //5.30E−120//271aa//82%//P49711
TESTI20198540
TESTI20198600
TESTI20199110//disintegrin-like testicular metalloproteinase (EC 3.4.24.-) IVb—crab-eating macaque (fragment) //1.00E−167//331aa//84%//I65253
TESTI20199980
TESTI20200120
TESTI20200840
TESTI20201760//SYNAPTONEMAL COMPLEX PROTEIN 1 (SCP-1 PROTEIN).//4.70E−09//189aa//25%//Q15431
TESTI20202830
TESTI20204260
TESTI20205100//TRICHOHYALIN.//2.60E−15//343aa//24%//P37709
TESTI20205150
TESTI20205250//phosphatidylinositol-4-phosphate 5-kinase homolog T3K9.2 -*Arabidopsis thaliana* //4.20E−21//194aa//33%//T02098
TESTI20207170//Human testis-specific protein (TSPY) mRNA, complete cds.//6.60E−111//231aa//96%//U58096
TESTI20209050//HYPOTHETICAL 113.1 KDA PROTEIN IN PRE5-FET4 INTERGENIC REGION.//1.90E−05//462aa//22%//Q04893
TESTI20210030
TESTI20210570//RETINAL-BINDING PROTEIN (RALBP).//5.00E−53//327aa//36%//P49193
TESTI20211380
TESTI20212970//PUTATIVE ATP-DEPENDENT RNA HELICASE YIR002C.//5.90E−85//458aa//32%//P40562
TESTI20214630
TESTI20215310//*Homo sapiens* calcyclin binding protein mRNA, complete cds.//6.60E−95//182aa//100%//AF057356
TESTI20219110//TYROSINE-PROTEIN KINASE-LIKE 7 PRECURSOR (COLON CARCINOMA KINASE-4) (CCK-4).//4.00E−23//53aa//100%//Q13308
TESTI20219390
TESTI20220230//*Bos taurus* Reissner's fiber glycoprotein I mRNA, partial cds.//1.20E−10//77aa//50%//AF078930
TESTI20221790
TESTI20222030//*Homo sapiens* very long-chain acyl-CoA synthetase (BG1) mRNA, complete cds.//6.10E−172//643aa//50%//AF179481
TESTI20222460//DYNEIN GAMMA CHAIN, FLAGELLAR OUTER ARM.//1.50E−138//589aa//46%//Q39575
TESTI20223380
TESTI20226520//TUBULIN-TYROSINE LIGASE (EC 6.3.2.25) (TTL).//6.70E−06//164aa//30%//P38160
TESTI20227380//DEAD BOX PROTEIN 4 (VASA HOMOLOG) (RVLG).//1.10E−263//577aa//86%//Q64060
TESTI20228120//RHO-GTPASE-ACTIVATING PROTEIN 6 (RHO-TYPE GTPASE-ACTIVATING PROTEIN RHOGAPX-1) (FRAGMENT).//4.50E−12//164aa//34%//O54834
TESTI20228740//ZINC FINGER PROTEIN 135.//3.50E−25//132aa//43%//P52742
TESTI20244220//MYOSIN HEAVY CHAIN IB (MYOSIN HEAVY CHAIN IL).//6.50E−11//77aa//42%//P19706
TESTI20244430//ANKYRIN 1 (ERYTHROCYTE ANKYRIN) (ANKYRIN R) (ANKYRINS 2.1 AND 2.2).//3.70E−15//173aa//35%//P16157
TESTI20244460//ADENYLATE KINASE, CHLOROPLAST (EC 2.7.4.3) (ATP-AMP TRANSPHOSPHORYLASE).//3.60E−34//209aa//37%//P43188
TESTI20244730//*Mus musculus* alpha/beta hydrolase-1 mRNA, complete cds.//8.20E−113//266aa//81%//AF189764
TESTI20245600//HYPOTHETICAL 118.4 KDA PROTEIN IN BAT2-DAL5 INTERGENIC REGION PRECURSOR.//4.50E−05//236aa//27%//P47179
TESTI20245860
TESTI20246410
TESTI20246480//*Homo sapiens* germline specific RNA binding protein (DAZL1) mRNA,complete cds.//5.00E−22//86aa//55%//U66726
TESTI20247440//Human BLu protein testis isoform (BLu) mRNA, complete cds.//5.40E−45//91aa//96%//U70880
TESTI20248850
TESTI20249360//*Homo sapiens* DEME-6 mRNA, partial cds.//4.70E−94//299aa//56%//AF007170
TESTI20250220//TRICHOHYALIN.//5.40E−54//537aa//30%//P37709
TESTI20250630//*Columba livia* mRNA for 5'-nucleotidase.//3.80E−115//328aa//66%//AJ131243
TESTI20251440//*Rattus norvegicus* (rsec6) mRNA, complete cds.//3.80E−31//379aa//28%//U32575
TESTI20251610//INTER-ALPHA-TRYPSIN INHIBITOR HEAVY CHAIN H2 PRECURSOR (ITI HEAVY CHAIN H2).//1.10E−07//182aa//26%//O02668
TESTI20251740//FYN-BINDING PROTEIN (SLP-76 ASSOCIATED PROTEIN) (SLAP-130).//6.30E−16//88aa//50%//O15117
TESTI20252690//SEGMENT POLARITY PROTEIN DISHEVELLED HOMOLOG DVL-3 (DISHEVELLED-3) (DSH HOMOLOG 3) (KIAA0208).//4.60E−137//304aa//85%//Q92997
TESTI20254030//*Homo sapiens* actin-binding double-zinc-finger protein (abLIM) mRNA, complete cds.//6.70E−150//280aa//96%//AF005654
TESTI20254090
TESTI20254480
TESTI20254990//ZINC FINGER PROTEIN GLI3 (NEURAL SPECIFIC DNA BINDING PROTEIN XGLI3) (XGLI-3).//6.50E−46//105aa//75%//Q91660
TESTI20255460//*Mus musculus* mRNA for MIWI (piwi), complete cds.//1.50E−225//864aa//49%//AB032604
TESTI20256560//NUF1 PROTEIN (SPINDLE POLY BODY SPACER PROTEIN SPC110).//5.70E−05//590aa//19%//P32380
TESTI20257910//HLA CLASS I HISTOCOMPATIBILITY ANTIGEN, ALPHA CHAIN G PRECURSOR (HLA G ANTIGEN).//1.90E−122//223aa//100%//P17693
TESTI20258720//ANKYRIN-1 (ERYTHROCYTE ANKYRIN) (ANKYRIN R) (ANKYRINS 2.1 AND 2.2).//1.20E−10//233aa//27%//P16157

TESTI20259110
TESTI20259200
TESTI20260140
TESTI20260640//helicase II homolog—fruit fly (*Drosophila* sp.)//2.70E-27//374aa//27%//T13889
TESTI20261040//DPY-19 PROTEIN.//2.10E-47//316aa//34%//P34413
TESTI20261160//*Mus musculus* rasGAP-activating-like protein mRNA, complete cds.//1.60E-21//129aa//41%//AF086714
TESTI20261680//HEAT SHOCK PROTEIN 30C.//1.70E-08//136aa//27%//P30218
TESTI20262150//*Rattus norvegicus* mRNA for voltage-gated ca channel, complete cds.//0//822aa//87%//AB018253
TESTI20262940//TUBULIN—TYROSINE LIGASE (EC 6.3.2.25) (TTL).//5.70E-10//218aa//25%//P38160
TESTI20264530//PUTATIVE SERINE/THREONINE-PROTEIN KINASE PKWA (EC 2.7.1.-).//5.60E-18//219aa//34%//P49695
TESTI20264910
TESTI20265150
TESTI20265340
TESTI20265890
TESTI20266050//52 KDA RO PROTEIN (SJOGREN SYNDROME TYPE A ANTIGEN (SS-A)) (RO(SS-A)).//2.10E-77//472aa//38%//P19474
TESTI20268240//*Homo sapiens* membrane-associated nucleic acid binding protein mRNA, partial cds.//1.90E-52//412aa//36%//AF255303
TESTI20269250
TESTI20269360
TESTI20270130//FIBRILLARIN.//2.10E-11//97aa//43%//Q22053
TESTI20271790//Human p76 mRNA, complete cds.//6.9e-317//496aa//99%//U81006
TESTI20272380
TESTI20274960//ZINC FINGER PROTEIN 83 (ZINC FINGER PROTEIN HPF1).//7.90E-126//342aa//63%//P51522
TESTI20277300
TESTI20278280//*Mus musculus* p53 apoptosis-associated target (Perp) mRNA, complete cds.//3.40E-84//155aa//88%//AF249870
TESTI20282420//*Mus musculus*-EPCS26 mRNA, complete cds.//2.40E-19//122aa//33%//AF250838
TESTI20282530//ZINC FINGER PROTEIN 135.//1.60E-56//271aa//39%//P52742
TESTI20282900
TESTI20284260//HISTONE H2B F (H2B 291A).//2.10E-22//120aa//43%//P10853
TESTI20285230//DOUBLE-STRANDED RNA-SPECIFIC EDITASE 1 (EC 3.5.-.-) (DSRNA ADENOSINE DEAMINASE) (RNA EDITING ENZYME 1).//2.10E-20//192aa//38%//P51400
TESTI20286590//Human type 3 inositol 1,4,5-trisphosphate receptor (ITPR3) mRNA, complete cds.//1.00E-93//185aa//100%//UO1062
TESTI20287760
THYMU10004280//ZINC-FINGER PROTEIN HT2A (72 KDA TAT-INTERACTING PROTEIN).//7.90E-13//87aa//42%//Q13049
THYMU20006020//ISOCITRATE DEHYDROGENASE [NAD] SUBUNIT ALPHA, MITOCHONDRIAL PRECURSOR (EC 1.1.1.41) (ISOCITRIC DEHYDROGENASE) (NAD+-SPECIFIC ICDH).//2.60E-120//229aa//99%//P50213
THYMU20007020
THYMU20007750
THYMU20008000
THYMU20009460
THYMU20009500
THYMU20009710
THYMU20010180//MOB1 PROTEIN (MPS1 BINDER 1).//2.60E-31//136aa//50%//P40484
THYMU20010710
THYMU20012020
THYMU20012560
THYMU20013250//LIM DOMAIN KINASE 2 (EC 2.7.1.-) (LIMK-2).//3.50E-213//354aa//99%//P53671
THYMU20013810//Human SEC7 homolog Tic (TIC) mRNA, complete cds.//2.30E-88//138aa//96%//U63127
THYMU20014430
THYMU20017270
THYMU20018250
THYMU20018390
THYMU20019000
THYMU20019260//ZINC FINGER PROTEIN 85 (ZINC FINGER PROTEIN HPF4) (HTF1).//6.80E-49//137aa//68%//Q03923
THYMU20020370
THYMU20020800//LMBR1 long form [*Mus musculus*].//3.00E-69//198aa//55%//AAF91092
THYMU20021090//*Homo sapiens* Sex comb on midleg homolog 1 isoform 1 (SCMH1) mRNA, complete cds.//4.40E-80//149aa//63%//AF149045
THYMU20021540
THYMU20023560//DNA BINDING PROTEIN RFX2.//6.70E-25//59aa//94%//P48378
THYMU20024500//NEUROFILAMENT TRIPLET M PROTEIN (160 KDA NEUROFILAMENT PROTEIN) (NF-M).//6.20E-06//296aa//22%//P16053
THYMU20025480
THYMU20026950//*Mus musculus* ROSA 26 transcription AS ROSA26AS mRNA, complete cds.//2.20E-12//285aa//23%//U83176
THYMU20028150//AXONIN-1 PRECURSOR (AXONAL GLYCOPROTEIN TAG-1) (TRANSIENT AXONAL GLYCOPROTEIN 1).//2.20E-33//301aa//31%//Q02246
THYMU20028410//*Mus musculus* Pax transcription activation domain interacting protein PTIP mRNA, complete cds.//1.70E-144//345aa//81%//AF104261
THYMU20029830
THYMU20030460//*Homo sapiens* tumor endothelial marker 7 precursor (TEM7) mRNA, complete cds.//2.10E-123//230aa//99%//AF279144
THYMU20030690
THYMU20031330//*Homo sapiens* putative nucleotide binding protein mRNA, complete cds.//1.00E-18//64aa//82%//AF118394
THYMU20032820//ZINC FINGER PROTEIN 135.//1.40E-82//258aa//55%//P52742
THYMU20034400//26S proteasome subunit p44.5 [*Homo sapiens*]//8.80E-29//71aa//91%//AB003102
THYMU20034790
THYMU20036500
THYMU20039320//PUTATIVE SERINE/THREONINE-PROTEIN KINASE PKWA (EC 2.7.1.-). //1.40E-09//206aa//27%//P49695
THYMU20043440
THYMU20043560
THYMU20044100
THYMU20044520
THYMU20046350
THYMU20046770

THYMU20049060//SPLICING FACTOR, ARGININE/ SERINE-RICH 2 (SPLICING FACTOR SC35) (SC-35) (SPLICING COMPONENT, 35 KDA) (PR264 PROTEIN).//6.00E−41//119aa//76%//P30352
THYMU20050010
THYMU20051340
THYMU20052460//PHORBOLIN I (FRAGMENTS).//5.80E−20//111aa//45%//P31941
THYMU20052830//*Homo sapiens* mRNA for immunoglobulin lambda heavy chain.//1.50E−237//477aa//90%//Y14737
THYMU20054800
THYMU20055450
THYMU20055460//ESTERASE D (EC 3.1.1.1).//7.60E−57//107aa//100%//P10768
THYMU20055740
THYMU20055760//*Mus musculus* group IIF secreted phospholipase A2 (Pla2g2f) mRNA, complete cds.//1.70E−73//165aa//75%//AF166099
THYMU20058550
THYMU20060480
THYMU20062520
THYMU20062610//DYNEIN GAMMA CHAIN, FLAGELLAR OUTER ARM.//1.70E−156//585aa//50%//Q39575
THYMU20062770//UROMODULIN PRECURSOR (TAMM-HORSFALL URINARY GLYCOPROTEIN) (THP).//4.20E−22//253aa//28%//P27590
THYMU20063650//*Homo sapiens* mRNA for putative ribulose-5-phosphate-epimerase, partial cds.//9.30E−57//116aa//97%//AJ224326
THYMU20064680
THYMU20066660//*Homo sapiens* putative ATP-dependent RNA helicase ROK1 mRNA, complete cds.//9.20E−153//361aa//85%//AF077033
THYMU20069130
THYMU20069460
THYMU20069650
THYMU20070250//TRANSKETOLASE (EC 2.2.1.1) (TK).//4.50E−288//513aa//96%//P29401
THYMU20071120//ZINC FINGER PROTEIN 85 (ZINC FINGER PROTEIN HPF4) (HTF1).//1.40E−229//536aa//74%//Q03923
THYMU20071460
THYMU20072580
THYMU20073070
THYMU20073080
THYMU20077250//T-CELL-SPECIFIC TRANSCRIPTION FACTOR 1 (TCF-1) (T-CELL FACTOR 1) (TRANSCRIPTION FACTOR-7).//4.10E−90//176aa//96%//Q00417
THYMU20078020
THYMU20078240
THYMU20079690
THYMU20080490
THYMU20081110//PINCH PROTEIN (PARTICULARY INTERESTING NEW CYS-HIS PROTEIN).//4.00E−28//60aa//86%//P48059
THYMU20083390
THYMU20083500
THYMU20083830//*Homo sapiens* angiostatin binding protein 1 mRNA, complete cds.//2.30E−09//230aa//28%//AF286598,
THYMU20084520
THYMU20086430
THYMU20087270//POTENTIAL PHOSPHOLIPID-TRANSPORTING ATPASE IIB (EC 3.6.1.-).//7.20E−154//235aa//88%//P98195
THYMU20089170
THYMU20089900
THYMU20090230//*Homo sapiens* ribonucleoprotein mRNA, complete cds.//9.30E−73//133aa//100%//L32610
THYMU20091040
THYMU20095920//*Homo sapiens* nuclear prelamin A recognition factor mRNA, complete cds.//2.90E−94//178aa//100%//AF128406
THYMU20096580//SERYL-TRNA SYNTHETASE (EC 6.1.1.11) (SERINE—TRNA LIGASE) (SERRS).//9.90E−20//45aa//97%//P49591
THYMU20097920//mitogen inducible gene mig-2—human//2.50E−197//477aa//55%//S69890
THYMU20098350//KERATIN, TYPE II CYTOSKELETAL 5 (CYTOKERATIN 5) (K5) (CK 5) (58 KDA CYTOKERATIN).//3.40E−267//577aa//89%//P13647
THYMU20099060//IG ALPHA-1 CHAIN C REGION.//1.70E−196//353aa//99%//P01876
THYMU20100940//POTENTIAL PHOSPHOLIPID-TRANSPORTING ATPASE IR (EC 3.6.1.-) (FRAGMENT).//0//646aa//99%//Q9Y2G3
THYMU20104480//TRICHOHYALIN.//2.90E−21//300aa//28%//P37709
THYMU20106990//*Mus musculus* evectin-2 (Evt2) mRNA, complete cds.//2.20E−112//222aa//90%//AF189817
THYMU20110720//PROBABLE AMINOTRANSFERASE T01B11.2 (EC 2.6.1.-).//6.90E−40//211aa//41%//P91408
THYMU20112570
THYMU20112590//*Homo sapiens* AP-4 adaptor complex beta4 subunit mRNA, complete cds.//3.40E−306//534aa//99%//AF092094
THYMU20115380
THYMU20115730
THYMU20117850
THYMU20120240//*Arabidopsis thaliana* ubiquitin-specific protease (AtUBP4) mRNA, complete cds.//4.10E−18//179aa//28%//U76846
THYMU20120730//ALDEHYDE DEHYDROGENASE, DIMERIC NADP-PREFERRING (EC 1.2.1.5) (ALDH CLASS 3).//2.10E−203//379aa//99%//P30838
THYMU20121040//ELONGATION FACTOR 1-DELTA (EF-1-DELTA).//5.30E−149//281aa//99%//P29692
THYMU20128910
THYMU20129020
THYMU20130470
THYMU20134260
THYMU20137050
THYMU20137570
THYMU20139160
THYMU20140510
THYMU20143230//*Homo sapiens* mRNA for stabilin-1 (stab1 gene).//1.70E−177//317aa//99%//AJ275213
THYMU20145990//nesca protein [*Homo sapiens*].//1.90E−152//282aa//98%//NP_055143
THYMU20148010
THYMU20149230
THYMU20150190
THYMU20151610//*Homo sapiens* antigen NY—CO-1 (NY—CO-1) mRNA, complete cds.//1.40E−181//344aa//100%//AF039687
THYMU20153210//*Homo sapiens* Diff33 protein homolog mRNA, complete cds.//4.00E−120//404aa//54%//AF164794
THYMU20154790
THYMU20157620
THYMU20163600
THYMU20170080//*Homo sapiens* SIT protein.//9.50E−48//78aa//98%//AJ010059

THYMU20170230//*Homo sapiens* sarcosine dehydrogenase (SARDH) mRNA, complete cds.//1.80E−183//260aa//99%//AF095735
THYMU20171580
THYMU20174490
THYMU20174790
THYMU20175260
THYMU20176010//VEGETATIBLE INCOMPATIBILITY PROTEIN HET-E-1.//1.80E−20//256aa//28%//Q00808
THYMU20177070
THYMU20178440//*Homo sapiens* mRNA for immunoglobulin lambda heavy chain.//2.20E−229//479aa//88%//Y14737
THYMU20181890
THYMU20184550
THYMU20185470
THYMU20185650//DIAPHANOUS PROTEIN HOMOLOG 1.//1.30E−20//85aa//44%//060610
THYMU20187210
THYMU2019.1970//*Homo sapiens* FLAMINGO 1 mRNA, partial cds.//1.80E−54//450aa//36%//AF234887
TKIDN10000620//*Homo sapiens* Tax interaction protein 2 mRNA, partial cds.//1.20E−56//114aa//100%//AF028824
TKIDN10001710
TKIDN10001920//ZINC FINGER PROTEIN 85 (ZINC FINGER PROTEIN HPF4) (HTF1).//3.20E−97//226aa//73%//Q03923
TRACH20011010//GLUCOAMYLASE S1/S2 PRECURSOR (EC 3.2.1.3) (GLUCAN 1,4-ALPHA-GLUCOSIDASE) (1,4-ALPHA-D-GLUCAN GLUCOHYDROLASE).//4.30E−17//593aa//22%//P08640
TRACH20011540//TUMOR-ASSOCIATED ANTIGEN L6.//4.70E−57//113aa//97%//P30408
TRACH20012490
TRACH20021000
TRACH20021380//ADENYLATE CYCLASE, TYPE V (EC 4.6.1.1) (ATP PYROPHOSPHATE-LYASE) (CA (2+)-INHIBITABLE ADENYLYL CYCLASE).//1.20E−276//492aa//95%//P30803
TRACH20025370
TRACH20026640
TRACH20029880
TRACH20040390//MATERNAL PUMILIO PROTEIN.//1.20E−177//812aa//47%//P25822
TRACH20041090
TRACH20043360//PUTATIVE KINESIN-LIKE PROTEIN C2F12.13.//2.30E−55//333aa//39%//014343
TRACH20044990
TRACH20049500
TRACH20051590
TRACH20057200
TRACH20058000
TRACH20073990
TRACH20080810
TRACH20081270
TRACH20090060//SYNAPTOTAGMIN IV.//1.10E−12//301aa//25%//P40749
TRACH20091070//ALDEHYDE DEHYDROGENASE, DIMERIC NADP-PREFERRING (EC 1.2.1.5) (ALDH CLASS 3).//1.00E−173//328aa//98%//P30838
TRACH20093400//TRICHOHYALIN.//2.30E−13//701aa//20%//P37709
TRACH20093480
TRACH20098510//MYOSIN HEAVY CHAIN, GIZZARD SMOOTH MUSCLE.//1.10E−20//640aa//21%//P10587
TRACH20101590
TRACH20104510
TRACH20108240//ribonucleoprotein—African clawed frog//4.10E−118//223aa//96%//S40774
TRACH20113020//SELENIDE, WATER DIKINASE 2 (EC 2.7.9.3) (SELENOPHOSPHATE SYNTHETASE 2) (SELENIUM DONOR PROTEIN 2).//1.80E−207//364aa//96%//Q99611
TRACH20122980//HYPOTHETICAL PROTEIN MJ0798.//6.80E−13//211aa//22%//Q58208
TRACH20123870
TRACH20124970
TRACH20125620
TRACH20129180
TRACH20131230//*Homo sapiens* oxysterol binding protein-related protein 3 (ORP3) mRNA, complete cds.//7.50E−282//608aa//62%//AY008372
TRACH20139280
TRACH20140180
TRACH20143710//RAB GERANYLGERANYLTRANSFERASE ALPHA SUBUNIT (EC 2.5.1.-) (RAB GERANYL-GERANYLTRANSFERASE ALPHA SUBUNIT) (RAB GG TRANSFERASE) (RAB GGTASE).//9.70E−07//142aa//33%//Q92696
TRACH20149500//KERATIN, TYPE I CUTICULAR HA6 (HAIR KERATIN, TYPE I HA6).//1.10E−62//215aa//60%//076013
TRACH20149720
TRACH20149740//EXCITATORY AMINO ACID TRANSPORTER 5 (RETINAL GLUTAMATE TRANSPORTER).//5.00E−76//152aa//98%//000341
TRACH20158240
TRACH20159390
TRACH20160800
TRACH20163470//*Mus musculus* putative thymic stromal co-transporter TSCOT mRNA, complete cds.//3.20E−41//187aa//34%//AF148145
TRACH20164100//RETROVIRUS-RELATED PROTEASE (EC 3.4.23.-).//1.40E−32//113aa//56%//P10265
TRACH20164810
TRACH20165330
TRACH20165540//Human alpha-1 type I collagen gene surrounding osteogenesis imperfecta OI type II deletion.//4.00E−05//102aa//37%//M11162
TRACH20167090
TRACH20170860//IG DELTA CHAIN C REGION.//1.60E−212//383aa//100%//P01880
TRACH20173680//*Homo sapiens* mRNA for LAK-4p, complete cds.//3.50E−80//410aa//38%//AB002405
TRACH20174980
TRACH20182780
TRACH20185120
TRACH20188350//*Homo sapiens* mRNA for centaurin beta2.//3.80E−60//204aa//56%//AJ238248
TRACH20190460//MONO- AND DIACYLGLYCEROL LIPASE PRECURSOR (EC 3.1.1.-) (MDGL).//2.60E−11//195aa//28%//P25234
UMVEN10001380
UTERU10001060//ETS-DOMAIN PROTEIN ELK-1.//1.40E−39//88aa//93%//P19419
UTERU10001870
UTERU20000230
UTERU20000950//*Homo sapiens* PC326 protein (PC326) mRNA, complete cds.//2.80E−55//112aa//100%//AF150734

UTERU20011760
UTERU20013890
UTERU20016580//POTENTIAL TRANSCRIPTIONAL ADAPTOR.//1.90E-37//323aa//31%//Q02336
UTERU20026620//ZINC FINGER PROTEIN 75.//7.50E-82//174aa//82%//P51815
UTERU20027360
UTERU20029930
UTERU20031350
UTERU20035770
UTERU20040150
UTERU20040370
UTERU20040390
UTERU20040730
UTERU20041630//ZINC FINGER PROTEIN 184 (FRAGMENT).//3.30E-75//239aa//44%//Q99676
UTERU20041970
UTERU20045200
UTERU20051790//guanylate kinase-interacting protein 1 Maguin-1, membrane-associated-rat//8.20E-26//267aa//33%//T18293
UTERU20064120//MYELOID UPREGULATED PROTEIN.//1.30E-79//245aa//66%//O35682
UTERU20065470
UTERU20079240
UTERU20083020
UTERU20086530//GLYCODELIN PRECURSOR (GD) (PREGNANCY-ASSOCIATED ENDOMETRIAL ALPHA-2 GLOBULIN) (PEG) (PAEG) (PLACENTAL PROTEIN 14) (PROGESTERONE-ASSOCIATED ENDOMETRIAL PROTEIN) (PROGESTAGEN-ASSOCIATED ENDOMETRIAL PROTEIN).//6.00E-73//140aa//99%//P09466
UTERU20087070//COMPLEMENT C1R COMPONENT PRECURSOR (EC 3.4.21.41).//4.80E-206//360aa//99%//P00736
UTERU20087850//Homo sapiens mRNA for mucolipidin (ML4 gene).//2.70E-34//184aa//42%//AJ293970
UTERU20089300
UTERU20089390//Plectonema boryanum kinesin light chain (KLC) gene, complete cds.//3.30E-38//216aa//43%//U78597
UTERU20089620//Homo sapiens radical fringe (RFNG) gene, partial cds.//1.50E-31//65aa//100%//AF108139
UTERU20090940
UTERU20091470
UTERU20094830//SINGLE-MINDED HOMOLOG 2 (SIM TRANSCRIPTION FACTOR) (MSIM).//8.70E-09//427aa//25%//Q61079
UTERU20095100
UTERU20099040//ZINC TRANSPORTER 2 (ZNT-2).//9.80E-96//242aa//76%//Q62941
UTERU20099510//ZINC FINGER PROTEIN 135.//2.20E-107//346aa//54%//P52742
UTERU20101150//NUCLEAR FACTOR NF-KAPPA-B P49 SUBUNIT.//2.20E-07//76aa//47%//Q04860
UTERU20102260
UTERU20103040
UTERU20103200
UTERU20104310//DNA-DIRECTED RNA POLYMERASE II 14.4 KDA POLYPEPTIDE (EC 2.7.7.6) (RPB6) (RPB14.4).//1.80E-48//97aa//100%//P41584
UTERU20106510
UTERU20121140
UTERU20122520//MOESIN (MEMBRANE-ORGANIZING EXTENSION SPIKE PROTEIN).//6.00E-37//399aa//28%//P26042
UTERU20125810
UTERU20127030//LAMININ BETA-2 CHAIN PRECURSOR (S-LAMININ).//6.80E-175//377aa//92%//P55268
UTERU20127150
UTERU20128560//26.4 KDA PROTEIN IN RUVC-ASPS INTERGENIC REGION.//2.60E-17//120aa//34%//P24237
UTERU20132620//AXONEME-ASSOCIATED PROTEIN MST101(2).//1.40E-15//231aa//31%//Q08696
UTERU20134830//pellino (Drosophila) homolog 2 [Homo sapiens] //1.40E-153//361aa//72%//NP_067078
UTERU20139760//solute carrier family 25 (mitochondrial carrier; peroxisomal membrane protein, 34kD), member 17 [Homo sapiens]//5.40E-100//203aa//97%//XP_001136
UTERU20140010
UTERU20167570
UTERU20168960//Homo sapiens actin filament associated protein (AFAP) mRNA, complete cds.//2.60E-68//364aa//43%//AF188700
UTERU20169020//HOMEOBOX PROSPERO-LIKE PROTEIN PROX1 (PROX 1).//1.30E-54//117aa//74%//Q91018
UTERU20173030
UTERU20176230
UTERU20177150//Homo sapiens zinc finger protein dp mRNA, complete cds.//4.60E-10//104aa//40%//AF153201
UTERU20181270
UTERU20185220//Human mRNA for transcriptional activator hSNF2a, complete cds.//1.60E-125//246aa//98%//D26155
UTERU20188670//HFM1 PROTEIN.//5.10E-19//234aa//26%//P51979
UTERU20188840

SEQUENCE LISTING (4096 sequences)

SEQ ID NO: 1 - DNA, 2283 bp, Homo sapiens
acaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcagggacctgagggagctcagggagggagagaagccagaagaccaggcagagactgaagagagctggcaaggcctggctagaaaaactccaggcaaggcctgtgcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttc

SEQ ID NO: 2 - DNA, 2240 bp, Homo sapiens
agagcctcgggcgctgcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtggactccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcgtctgtgctgctggggtcacgcgaggctgtttgcaggggacacggtcacaggagctcttctgccctgaacgctcccaacctgcctcccgcccggaagccacaggacccactcatgcgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcagtgttgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccgggactatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgggcctttaggtgaatgtgggatccactcccgcttttaacatgaaagcattagaag

SEQ ID NO: 3 - DNA, 1957 bp, Homo sapiens
ctccctggaggcagcctgagttttctgtcccctggtatgctgcagatactctccacagaaacaagcagatgcacatgtcaacagttttgcaagtgttgctcttttcccccaccttcttttgacatagctggggcagtttccatctctggtataaggtgccatcttattccatctctggtgtaagagtgtgttgctggatttgagtagttctaagcagcactgcaggagtccccctgttctgctgcatcattttgcacacatatgtgtctgtggaagacatggcccggtggggccccaccttgctgggggagagggatgtgtgtgtgatggtggtgcatgcttcccccttgctactccaggtgtctgccccatcccttcaccctggaggttccagacagcccctcttcaccagcgattccccaactcatctccagctcagatcccacccctgatctccagactcatggccccagctgcctcctgggctccttccccaggatgtgcctcaggggccactaaaggagccagtgcctcccacctgcccggatcgggtgctcctccagggatctttgttccagtgagtggtgccatcacctgtccaacctcatggaccagagcactgccctgtcccaatcacgttctcctatgcaccaccatacctacccctaaagttcttcctggcctcatcccgtcacctctgtctccatggccttggtcccagctcaagcctcgtcctctgccacctggaccatcggcccagcctcctctttggcctcccagcccccaacatccccccctcagtccatccccctaatggagagcttcctgacactagagctgacctcactactcccctgctcacagccctccgcgtggcctctcacctcccccaggatagagtcccaacccatccttctgtgtctcctcctctctgtgtccactgtcctgaccctaactcaatcctcattctctgcctcctggaccctcatcctagcctcgtgacttctggtctaagatgtgagagcacctggcaaggtaaatgctccaggaggggttgctccctcccatttcctgccaccagaaaatgttatcggctgcgtggcattgcgaaagccttcctcttcccagcctagggtttcatgtgggcatttaggtgctcccagtgcatagttgcatggcaaacaatcctaaaatatacaagactacatttagtattttgtaaaattctttactaaccccaaattgtctactggaaactataggctcctttttttttggtgggtggggggcaggtgtgtttgtgggatggagtttcacttgtcacccaggctggagtgcagtggctcaattttggctcaatgcaacctccacctcccaggttcaagcaattctcttgcctcagcctcctgagtagctgggattacaaccgtgtgccaccacacccagccaatttttgtatttttagtagagaccgggtttcaccatgttggccaggctggtcttgaactcctgacctcaagcgatccaccttagtctcctaaagtgctgggattacatgtgtgagccaccgcccctggcctctgtaggcttctttaacccatcagagagactccctggtaaggattaggggctaattactggtgcctcttcagctgtcagtccatcctcctttatttgtacccaccttccagtcagcaaggcacaacaatgttgttacaaaggaaacaaactcaatttggcccatttcctggaaatgcaatctcccaaacaggtttgtgtgaaccaaattccattttcctttgtttcccatgtgcagtcccagttgcatttccatgggagccaatccacccacccatagaatgacttgaaaatgtgtgaagttcagaagtttcataccaagaagtttgctgagcatgatgtttgtatattgattaggagtaaaaatgttcatttttac

SEQ ID NO: 4 - DNA, 2660 bp, Homo sapiens
agatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 5 - DNA, 2881 bp, Homo sapiens
attaaatatcctccagccttcagcaggagaaggcaagtctgagatcaacctccaccctttaggttttctcaacccgaatgtaaacgctgctttagcttttctctccagtgacatggatgggcaggtattgcagcctgttcactttcagctcttagcagccttgcttcagaaccaagcccaagcagctgccatgtttcccctgccatctttcaatctgaccttctcagatcttttgcaacagcaaaatacccctttaccctcattaacacagatgacagccccaccagaccatttgccaagcaatcagtcagacaacagccgagctgagacccttttaaccagccccctggggaaccctttatcaagctttgcaggcagtgacactacttttaaccccctgttcctcccagctgtcaatggggcctcaggattaatgaccttgaatccccagctgttgggaggtgtcctgaactcggcatcggccaacaccgctaatcatccagaggtttccatagcaacctcctcccaggcaaccactaccacaaccactacatcatcagcagtggcagcactgactgtctcaacacttggtgggacagcagtggtgtcaatggcagaaacattgctgaatatatctaataatgctgggaatacacctggtccagctaaactcaacagtaactctgtggtgccacagctacttaaccctctactggggacaggtctacttggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacactacacttccaccttttcaagatacaccttgtgagttgcaaccgaggattgacccatctcttggtcaacaggtgaaggatggcctcgttgtgggtggcccaggtgatgcttccgtagatgccatttacaaagcagttgtcgatgcagccagcaaaggaatgcaggttgtcatcaccactgcagtcaacagtacaactcagatcagccccattccagctctgagtgccatgagtgccttcactgcctcaattggtgacccattaaatctctccagtgctgtcagtgcggtcattcatggacggaacatgggaggtgttgatcatgatggtaggctgaggaattcaagaggggctcggctgcccaagaatctagaccatgggaaaaatgtgaacgaaggagatgggtttgaatatttcaagtcagcaagttgccacacatccaaaaaacagtgggacggggagcaaagccccagaggggagcgaaacaggtggaagtacgaggaatttttagatcatccaggccatatccacagtagtccttgtcatgaaaggcccaacaatgtctctacactgccatttctgcctggggaacagcacccaatactgttaccaccaagaaactgtccaggggataaaattctagaggaaaatttcaggtataataactacaaaagaactatgatgagttttaaggagagactagagaacactgtggaaagatgtgcacacataaatgggaatagacctcgacagagtcggggatttggagagctgctaagcactgcaaagcaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaggggaaggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacct

SEQ ID NO: 6 - DNA, 2782 bp, Homo sapiens
agtgaatgcggtcctgtaaatgctggcgatcttgtagcagtgctgattagcgagttgctccaacacctcctcataattttttcctgctcatcactcacctgctttgtcaaaatgaacaagaaggaagcatgattgggctgtgcaccgaggcggcaaggaagccctggatgaccctcttaacagaggctgccaaggctccagcgcccactttctcagactcccttgctgctcaggatgaaatatgtagagctggagaagagacatggttagtccttatgtcctgccttaaatgatgatgtgatggccattatctggatccttcatggaatttcggcagttccaacgtgtcaggccagtgtctgggattctctcagcctttcgctttttcccctgggagtcggacagctgctgcagctcagtcagaccaaacctctctgaataccaccaagaatcgggatcttgttctgttgtccaggctggagtgcagtggtacaatcacagctcactgcagccttaacctcctgggctcaagacatcctcccacgtctgcctctcgagtagctcggaccacagagtcacccaggctggagtgtagtggcacgatcttggctaactgtaacctctgcctcctgggttcaagtaattctcctgcctcagccttctaagtagctgagattacaggcactcttcgccgcgcctggctaatttttgtataatatttttagcagagacggggttttgtcatgttggctaggctggtctcaaacacctggcctcaagcaatccacccgcctcagcctcccaaagtgctgggattacaggtgtgagccactgtgttcagcccttatgttttatttattcatttaacaattatttgttgcgtgctgctgagtgccaggcctgacgccggctgtgaagatttcagaagggcctgccaaaccgtccctgtccaaaacagctcactatcaagcatggttattttgtaagtgttctgcactggcttccttcttccctaatcagaccatctgttggatctcatggagctgtctcctatttctctgtaatcaagccacagtatctaacatttggggccactggtaacttgccgtctactcccatgctggaagcccaggacccttgaacataagaggcgccttctgacacctgcggtgctgtcagagcctgcaggctgcagacagtgagtcaggaactggagaattcccaggagtggtataaggagctgggactcgcgtcagacagggaaaggactgacagagaccaggacagaacaggaagcacaaggaaagtcaagaggagagtaatgaccgcaatcccaaggtagactggactggagtgtctggagggtccgacaggagaagggcatttgtgttcatcacggagctactaggagaaagaagagcctgggtcttagcaaggatgtggtcaggacacaacaatagagtggacccctccagtgagtgtggactatgacttatggcaggcccaagggtcccagcgcagggtggggtggggagggcatggcttgctgtagcatcacgcactgctagtcaccatctacccagtacaggtcaccaatgatggaacagctacagcctcctccccttcccctgtactccctgtgcccccttctttttttttttttgagatggagtctcgttctgtcacccaggctggagtgcagtggcgcgatctcggcttactgcaagctgcgcctcccaggttcacgccattctcctgcctcagcctctcgagtagctgggactacaggcacctgccacgatgcctggctaattttttatattttttagtagaggtggggtttcactgtgttagccaggatggtctcgatctcctgaccttgtgatccgcccgcctcagcctcccaaagtgctgggattacaggcctgagccaccgcgcccggcccctgtgccccccttcttaaacatgttctcaacagtggtttagcgatacccaagcaaggcctttgcatatgtgggaagttgtgcaccatgcaagagtgccacatgcaaacagcacctttccccgtgtagacactgtagatttacatacccttaccacatacccttccaggaacagggaagcaaaggctcttgaggaagagatttcccacaaaggtgctatgtgggttagtgttggcatgctcaccaagagatatttcaagctatttccaagggtattggaaaaatcatttataagcaaattctttttttacttatggaaaattttaagcatatacaaaaatagacaacagtatcatgaacctctacatatccatcacatgcaacttctttttaattcgcttaaatttaaaaatagatacgtgaaataaagcatttggggcagaagttcattgcaaaatcaaatgatagaatttcacagctcctgggcaatcaaatactccccttgtgccataaggagatttaggccttttatttccttttcttttacaatttgttttctttgctatcattcatatgtagagttctcctgcagtatgtagaaggtggacattgtcattttcaaaaatggagtaattatggcctatctacctgactgtgcagctatcaataataattattattataaagaccatataacagggaaaagcattattgattagtgttaataaacggtataaattgtacataaacagtgatgtctactgtgtgaacatatactagatatgcatgtaaacaaaaactagaggtaaattgaaaaaataaaatcagtttttgcatc

SEQ ID NO: 7 - DNA, 2469 bp, Homo sapiens
aagcgttccaacaatgttcaatacactgtctaagaaggcagggctgcgttttatccactttagaattatttccatccccaaacagttaaaatactttcacaaaagtcttggtgcttaaaagataaatgctcagtgacctggaagttcacataaatgaaacggttgatgatctgatgatgaaggataggcgagatgggtaaactcactcttttttttttttttgagatggagtctcactctgtcacccaggctggagtgcagtggcatgatctcggctcacggcagcctccgcctcccaggttcaagtgattctcctgcctcagcctcccaagtagctgggattacaggcgcccaccactttgcccagctaatttttggtatttttagtagagacggggccaccattttggccaggctggttgtgaactcctgacctcgtgattcgcccacctcctcctcccaaagtgctgggattataggtgtgggccaccgtgcccggccaaactcactcttttgaacttaacattttccccctgacattggagactctcctgctacctctctcctaagaaaaaagggcaggtggtggggggacaagccccttccaccttcccatctccaagggactttgcagtgtgggtgatggtgtggctgatcatcctctttctgcacctctgattctgcttgtgttgtccttattgtgtggggcaggagggttaggacttcagctaggggtgtgctggctctgcagtgactcaggcctgggtgttttttggtgaatttaaaaagatgaccatttctgggggaaagcgacacttttactttctccacaccttcaccatccatttccttactggacttcgctgcgttcctgcaaggaggacagggcagagagtagcaaccctccttgccgaggcccagaaagatagcgtggtgtgcccagggcacccatggtgggtgatggacatctccttttgggtgccaaggcttcctcaaggtgggaggaactggagggcaggggacggtggccagtgtcccgctctagccctctagggcacctttttctcccctctgaagttgttaggctgatctggagtctgctccaggcctgggcttcaccctggcctcatgccctgcccagcacctgtgtggagggacctgttcgtattcattcctctttgggggccaagctcagggcacccgaaccagcagccttgggtggctgaacctagtgggacagaagggaggcagttgtatctggcagagtcacccaaggccacaggcctgagcaaagcaggagagcagggcaagctggggtcagggaccatggtgctggccccctgctgctctggccatgtgggaggcagctggaggggtcccaagtggcagctcctgccagactaccccggactcccgagcccatcgtcctgtactcttctccagtgggacttctggccctcactgtggctagcttctgggcaagtccctctgctcaagatcactttatggggcagctggtgccccctggggctcccacactctgcacatacaatttagggacctggcagggtcttggtggcctgcagcttccctttctggaaccgactcgcctcccatcagagagccataactcttcttcaatacagtattgtttgaactttgaaatatatgcatttgtctatgtattttcttaaaaattaacactgtatctcaataagcatacaatggattgttcaatggtacagtttggaaccaatcccccgccacttccctccccaagtaaagccaggacagatgctggagtcagcatgggagctgtggaaaccttttgccctggagccaggtgcctgtggctgtgcctgggagtggcttcagcccaggcgtggtgtcagtttcctggcacccctgcccaggagcctgcatgaaggcagccgggtctctctctgagtggctggtgcaccggctcatttctgagtggcctcctgcgtatgaagaaaaagcggccacgtggcatgcctcccttccctcccttgctttcctctcaaagagccaagtcacgctgcactgcgctccgtggagcctttcccgatggagaagagaagggaggcctgagatgtcctttgctgggatgtggagaaacaccatctatatgaaaagccccttgcttgctctgctgattttctccctcccctggccctggagagaaaggctgtgccattcaaagacagtttggggacatgggggctgcaggcctgatcttatttttatgcaaattttgttctgggagcagtggtttatacaaactcctgtagcataattccagcttgtgtgtggctgtccttgagtagtgattctgaagtgatgactgtgatgctatgcctaaaaacatcatcagggtactttgtatctgtcactgtgtttgaacggccctcaatttctatctaataaaaccagtcaaatggttcacct

SEQ ID NO: 8 - DNA, 2290 bp, Homo sapiens
ctttttcctggatactcacgaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgacccagacctgggcgccgacgacgcgagtccgagagaggagccgcgggcgccgtggatggagcgggaggggccggagtattgggaccggaacacacagatctgcaaggcccaagcacggactgaacgagagaacctgcggatcgcgctccgctactacaaccagagcgagggcggttctcacaccatgcaggtgatgtatggctgcgacgtggggcccgacgggcgcttcctctgcgggtatgaacagcacgcctacgacggcaaggattacatcgctctgaacgaggacctgcgctcctggaccgcggcggacatggcagctcagatcaccaagcgcaagtgggaggcggcccgtcgggcggagcagcggagagtctacctggagggcgagttcgtggagtggctccgcagatacctggagaacgggaaggagacgctgcagcgcgcgggtaccaggggccacagggcgcctcccggatggcctgtagatctccggggctggcctcccacaagaaagggagacaaatgggaccaacactataatatcgccctccctctggtcctgagggagaagaatcctcctgggtttccagagagtgactctgagggtccgccgtgctctctgacacaattaagggatgaaatctctgaggaaatgaagggaagacaatccctggaatactgatgagtggttccctttgacgctggcagcagccttgggccccgtgacttttcctctcaggccttgttctctgcttcacactcaatgtgcctgggggtctgagtccagctcttctgagtccctcagcctccactcaggtcaggaccagaagtcgctgttccctcctcagggactagaattttccacggaataggagattatcccaggtgcctgtgtccaggctgttgtctgggttctgtgctcccttccccaccccaggcgtcctgtccattctcaagatggccacatgcgtgctggtggagtgtcccatgacagatgcaaaatgcctgaattttctgactcttcccgtcagacccccctaagacacatatgacccaccaccccatctctgaccatgaggccaccctgaggtgctgggccctgggcttctaccctgcggagatcacactgacctggcagcgggatggggaggaccagacccacacacggagctcgtggagaccaggcctgcaggggatggaaccttccagaagtgggcggctgtggtggtgccttctggagaggagcagagatacacctgccatgtgcagcatgagggtctgccagagcccctcaccctgagatgggagccatcttcccagcccaccatccccatcgtgggcatcgttgctggcctggttctacttgtagctgtggtcactggagctgtggtcgctgctgtaatgtggaggaagaagagctcagatagaaaaggagggagctactctcaggctgcaagcggcaacagtgcccagggctctgatgtgtctctcacagcgtgaaaggtgagaccttggggggcctgatgtgtggggggtgttgggggggaacagtggacacagctgtgctatggggttctttgaatttgatgttttgagcatgcgatgggctgccaaagtgtcatccattactgggacagatatgaatttgttcatgaatattttttctatagtgtgagacagctgccttgtgtgggactgagaggcaagatttgttcacaccttccctttgtgacttgaagaaccctgactttctgcaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggcggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacccatgag

SEQ ID NO: 9 - DNA, 2635 bp, Homo sapiens
tatttattgaaattaaaaaccaccaaaaagaacttaaattgatgagtttttacaaggtgaacagacaccaagaaactcagtatgatctgaaccccagaacctcactgaagtcccatttagtcactacctgcttcccaaacataaccactgttctgacttctgacacctctgattagctttgcctaaaaggttcatcttttttttttttttgagatggagtctcgctctgttgtccaggctggagtgcaatggtgcactctctgctcactgcaacatccgcctcccgggttcaagagattctcctgcctcagcctcctgagaagctgggattataggcacgcgccaccacgcctggctaatttttgtatttttagtggatatggggtttcaccatgttggtcaggctggtctcgaactcctgaccttgtgacccgcccgcctcggcctcccaaagtgctgggattaccggcatgagccaccacgcccagctggttcattattttaaaaacgtttttaattaaacttttttttttttgggatggagtctcactctgtcccccaggctggtatgtggtggtgcgatctcggctcactgcagcctccaccactcgggttcgggtggttctccggcctcagcctcgcgagtagctgggactacaggtatgcaccactgcgtccggctggtttttgtatttttggtggaaatgggtttcaccatgttggccaggctggtctcgggctcctgacctcaggtgatccgcccgcctcggcctcccaaagtgctgggattataggtgtgagccgccacgcccggcctttaattaaactttttatttggagataattgtagattcacatgcagttataagaaataatacacagagatcccatgtgcctttactcagttttccccagtgagactatcttgcaaaactgtagtacaatgtcacagccagatgttgacgttgatgcagtcaagatacagaacgttccatcaccacaaggagcctcatgctaccctttcataggcacacccacttccctcctgcccccagcctgtccttaacccctggtaagcactaatctgttctccatttctataattttatcatttcaagaatgttctataaatagaatcatatactatgtaaccttttgggattggcttttcactcagcataattctctggagatttatctagattattctgtgtattaatagttagctcctttatatattgctaagtagtattccaagggtttcattgcttttattttttatttatttctttattgtttttgagacagggtcttgctctgtcacccaggctgcagtgcagtgtcgccattatggctcactgcagccttgtcctccctggcccaagcgatcctcctgcttcagcctcccaagtagctgggaccaaaggggcatacttccacatccagctaatttttttatatatataatttttttttttttttgcaaagatggggtctttctatattacctaggctagactcaaacttctgggcgcaagcaatcctcccgtctcagcctcccagagtgctgggattacaggcgtgagccaccatgtctggccagttcattgcttttaatgcaggggacggattagtggtttttaacctttggtcacccatccctttgggagattcgttaaaagttattaatgctctccccagaaacatgcatacgtggaaagaggtgactataatttcagaggaggctctgaagccagccccacaaaaacatggtgagaaggtgatcaagtcttgaggaacccaagtgaagaagtgattaattctttgcaggggaagttcctgaagactcggatggtgtcatggtgggtgggaggaggggttctggttagaaacagcggggcaggcccagctcagcaccccacactcccagcaaaatctagatcttctggtttggaggtcagtgtgggtcattggcctcatcaggaacttcctttgtgaccttgaactaggcaccgtctcttcacttcccccatcattccacctgcacaagtgtgagcttggaagttctctctgcttaaactcactttgggttctctctctgcctccctagcggttcctggctcagagtttgaggggcacaaacggatttctgaacacccccttcccaacaagacaatcagcccacccccagcccccgcccctgccgctgcgcctctaccctgtggaccaacagagaccatccccagcttcctgctcaccagggcagggcgagagtaagttagacacttggatcctggggattcaagctcatcatacagacgggagcgtgatgcgacgtgttagcaggtggaggtggagacctgcccagctcacacagatggtggtggtaggagcagacggacccaggtgtcctgcctcccagttcccagcgtttctgtgggacctcattgatctagacatcgaggacacacttttccagccagtggaatatgacctaaagattcacctttctggtgctgacacttatgccctctctctccatcatctcttttccgagaaaagcctgtcctttctagggctatcttttctgcaatttgcccattgattgtatggaccaagaagctactgccttctg

SEQ ID NO: 10 - DNA, 1828 bp, Homo sapiens
aacataccttctccataaaacctttgctctccaagacctccttcacccgtatcttaagattcttccctgagccactgtgcctggccccaactccctatttaacaccctcccactaatgctttgcatcctaagccttctccccagcactctatcccccaacaccttatttcttcaaaatgctttctccccaacacaaacccctcctaaaccccattgtccccaaccccgcatacctctaacacccttcatttgtgacaccaatccaccctcatctctctcccgacacccaccttcccaacatcctttctcttcttagtcactaatctcggattcttccaatgtcctctaatcctcagaaccatctccccagcatgatttccccaagaccatttttctcaatgcctttccgcgggctataccaatgccatgtctttcctgtccgcctgcccctctcttgccaatgtgctttcctctcagtgctctctttccaccaaacccaaacccctgaccctatactctaacccctgcctcttcagcgttttcttctcaacacccaaaatccatcccttcaacctcttgctccttaacattccatccttccagcgtctccctctggtacctcatccgtcactccatccctcaacaatctcgtccccaacacccgcttctgcaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctttgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggc

SEQ ID NO: 11 - DNA, 2096 bp, Homo sapiens
ccccgtctgcccgctttctacagccaaccccacatgccctgccttctctcctttcactgtggatgaaccgcccgtgccccaagcaaagacaaaccctccacttgaacactcacttgctgaaggatgtggcttaggcagttttcctgtctcctgaagccacagtattccccttcaactggattcttctcctcagcatataaatatacttttttttcctatctttaaaaaaaaaaaagagtaaaatcaccccatttttttcctttacaatatgactcaaaagagtagttcatacttcctgcctccattttcttccctcacattatctcttaaacattctctgatcacgccagccaaattgctcttgtcaactcatttcccagttctcatttcacttgacttgttagcagttgacctctcctttcttctggaaagtttcttcgtttctccgaaacactcactgcacaagccttcatatctcctagtctccatcttgtctctttgacctctgatgtaaggactgagtccttggaccacttctcttttctatttatacttactccctgcgtcatcacccccagtcttgtggcttcaaatgctatctgtgtgtggatagctcctccagtccacacctcttttctgaatcttttttcaaattcacacatgtgaatttgaattccaggctcatcacatccaggtgtgttccccacacctccacctgaatgtctattagaaatctcacacccctcttgtccaaaactgagctcttgatctttaaccagaaactttatctcagctattggcaactccaggtttctgttttgctcaggccacagacttcagagtcattctcacactgccttttctctcatacaccattatgtacctgtcagcaggtcccaaatatctagaatttgattgcttcacatccctatagcaactctcctggttcaagcccatcatcatctggatttttgggaagtggtcttaactggtgtgctgcccttcccctctgctctcaaccctattttcaacatagcagtcagaataatctaaaatataaaccagatcatatcactcctctgctcaacaccccctcccaataccttcatgtcatcctcagagttattgtccaagcctctaactgtggtctacaagtctttacatgatctgtcctgttacattttccactctcgctccagacctgacctaagaggcttttctctgaacttgctaaacatgctcttacctgagggtccattcccactgcctctgcctggaatgctcttccccagacatgcatctgcgtggatcatttccatgcctcctcaggtctttgccctcatgaagccttccctgacaaccctatttaagattgtaatcccctcccacagtggcccctatctgctagagactgaatgtttttgtcccccccaaaattcctatgttgaagccttaatctcaacataggaggtttggcctttgtgagttagttttagatgaggtcatgtgggtaatagaattagtgcatttataagggcgtgaagagccctcactgtgaggaaaccagaatgtaagccttcaccagaacttcttcatgctggcaccctggtcttagacttcccagccactagatctgtgagaaagaaatgtttgttgtttaagccaccctgtctatggtactcttgttacagcaacctgaactaagacactatccctctcccctgctttctttttctgttatcaccataattaatgttttacttatatatgatttgttaatgtatgtctcttcccactagaaaccgaattctatgacagcaagggtttttgttttcattattgtcatattacctgtgcctggcatgtgataagccctaagtacttgttgactgaattaacatatgagatctgtgagtctgaaaaaagaagtacatcattccttcacatgtcattttgagccactgttaacagattacataactgttattggaagtgcctcactactccatttggaaagtattcctggaatacacgatgaatgactcagtagaagttctggctatgggggagtgccatcaataaataaaaataatacc

SEQ ID NO: 12 - DNA, 3135 bp, Homo sapiens
gcttctccccgacccaccccaaccacaagtgcccttgcccccttgacagtggcagaaaataggtcattcccgtagtagggatattagagatgtcacagagggttgtgttggcctatgaggggcaaaaaggcagcattgggggcaggggcagttgtcacagaatggccttggttcccggcctttgtccacaccatcccactgaacaggatgggaatctgagaccagaatggggacagagtgacggttcttaagagtggccactgagtggagaggaggccttgctgagggtgacttgggcaactcacctgctccctggtatggaggtaggggggtggggggcaggtcagacggcccttgtgtgctgagtagggaggttacccccgtagcagcagttgctggaaccagagtcatgggtgtgaggaccctgcccacgggagttaattcattagggctgaggtaagcccaggaggcttcaagtctgaaggaccccccaggcgattggaatctgcagcctggatctgggatgatggagaagagagcttgttgggatctgtattccatacttgggaggctgggccactcaccagctgctagaattttctttctggctgtccttggtgtctcagaaacatgcaaaggtggctgaggaagatctttgctcatcctcgagccaaagctcctggggtgagccaggtggccaagacatcaggagtcagtgggtggcccccagagaaggtcgtttcccctcccccccagaggaggagctggagagggcctcagtaggggtcctggggtcctggggacaggtctgtctttcgcttcatggctttagctctcactgcctgctctcaaacaaccccagggaagggggtcagcccaggggaggccccctccactgggaacaaatctggggttggggccaggctgagccagggtgcccccttcttcagcatgactctgagtcatggattttccagcatgagggtcaggcaaagtaagaccctccagggcttcctggggctctggagcaggggctcctcttgtccttggtccacctccaggaggggccggagagagaaaacctggaaccaaactcagtgggcagccctcctcttgcatgccgtgcccagctaagtgccctggagtcccgagcactcatctgcctgggctccaaagaggccctgctgtcccctgcctgcttccagggggtgggccagtgaactcgtagaggcaggcatctcgtcctttcttgcagctgtgacgggccaaggaaagaggggatccagcctcctccactgctcctctgctcctctgctcccacctggctgtgaaacctggggcgagtcatacctgcccctggccttgtctgtgagggactgggctggtggcacctaaagcccttccagttggggccgtctctgttgcacctgccctggcctcccctccagccctcccgagaagcatgctacccaggattacgcttttgtccccgcttcaccccatgctgtccgagccctgaagagacttcctctgtgtctagtcccaagaatagagttctgtcaaggacctccaagtcaccccttgctggaaagagagcattcttgagtgtggccgaggtcctgcttatcagcacagcgagtccactgccccagcccctggggctgctggaatgcaggagcctcccacccggacagggtcagctgctcacggctcccacagtagtccctggaatggagtgcgggagggagcactggtgctgagggcaggctgatcccagccactgccttccgacagggagtggccaggagcgaggctgcagacacagttttgttgcaccccagctggcccaggatgtgtgtactggcagccagtcctgccatccaggccctgggcttgctccaaggctgccagggtaccgggagctgtgttctgctcatgcaccagccttcaacatttcaccttgaccagtgacccactggatcttctcagggtcagggtttagccctgggggtctccactgtggtttgatcactcagaatgttttggggcctggtgtgattccctgctacagagcctacacagtcatgtactcaacctttggccaggatggggtgagttcagggtgctgctgatggtccgcacctgcagagtagaggctcaggcagacagcagatagcattctggcaattcccagagtcctgcagatgcttcagattctttgagaaccactgatgcagcccaacccttctctcttccagatgaggggatgagacccaaggcagggtgcaggggagatgggcagtggcgtgcctccactacacagcagtccagtgacaaagcagtcctcgaactcaggtccccgactctttccactcccctcaggcacccacgcagtcattcctccacccactcggcctctctgagcatcttccctgtgtcaggccccattctaggccccagggactcagcagggaaaaagagcagcccctgttctcatggggccactttagaggaagtagagagtcaacaaactaaattatgttgtaaaaaataaacaacatcatctcaatggtaataagggccagcaagacaagaaagccaggggatgagagtgagagggagagctgccttccaggaggggcctgtagaaggcagaggtgggagaacagatttctgggcaggggaagagcagatgcaaaggcctcaagcaggccagtgccaggtgggttgaggaacaggagcagtgtggctgtggcatgctgagtgaagtgaggagaagaggcagaaatctgtaagggctggacactgcagggccatggagaccatggtcaagagtttggatttttggctgggcgcggtggctcacacctgtaattccagcactttgaaaggctgaggcaggaggatcacctgaggtcaggagtttgagaccagcctggccaacatggtgaaaccctgtctctactaaaagaaatacaaaaaaattagccaggcgttgtggcatgtgcctgtaatcccagctactcgggaggctgaggcataagaagctcttgaacctgggaggcggaggttgcagcgagccgagatcgcgctattgtactccagcctggacaacaagagcaaaaactccatctc

SEQ ID NO: 13 - DNA, 2333 bp, Homo sapiens
tttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgcgtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaagccttgtgcagatgcatgggttacccaggtaaaggaggtggcatggcacatggcacgtggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgtggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggc

SEQ ID NO: 14 - DNA, 2014 bp, Homo sapiens
taaaagaatagattacttttgtacttgatataaatggtatcatatactatgttctgttttgtgtctgcctcattcactaagcattgtgttttgagagatctgtgttgctgccttagtcatagcttgctttttgctgtatggtgttccattgtgtgactttgtccagtctgctgtttatccagtctactgtccagtctgctgttgtttatcagtctactgttgatggccatctggttcatttccagtttgaggctattacaaatagggatgggcatcatgaacattttgtgcatgtctttggtgcacatatttctctatttctgttagggaggagtgttctgggttatagggtatggctatctttagttacggtagatgctgccagtttcacaaagtgttttaccagttaacacttccaccagcagtgtatgtaagagttccgggttgtttcacatttttgtcaactcttgctttttttttttgagatggagtctcactctgtctcccaggctggactgcagtggcgtgatctcagttcactgcaacctccacttcccaggttcaagcgattctcttacctcagcctcccaagtagctgggattacaggtgtgcaccaccacacccagctaatttttgtatttttagtagagatggggtttcaccatcttggccaggctggtctcgaactcctgacctcaggtgatcctcccgccttggcctctgaaagtactgggattacaggcatgagccaccatgcctggcgtttttttttttttgtttttttttttaatagttattttggttgtgccttggtatcacagtgtagttttaatttgcatttttaatagatatttaaattgagcaccttttcttggtttattggctactcagacagcctcttttatgaagacatccaaatatattctacgtttgagtcttttgtccatttttctgttgggctgtcttttttttgtttaataggaattctttatgtaatctgtcaggtagtattttatctccccagattatatttttagtttttaaatgatgtcttctgatatacagaagttcatgatgttataattgaatatgtaacttttttctctttctgtatcctgttcaagaaatagttgtctactccaaggtcatgcagatgtttttttctaaatgctttattgtcttgtcttttattttttatatctatggtctatttggtatggcttcgtgtgtgtggtgtgaggtagggattgagattctttttttccattgggatatctgattgacccagcatcattttctaaaagatgcctttcctcattgcactgcggcgcctcctgtgtgcttttgacagggatgacagggatgaggatgataaagaataggcatagcgtgtctttctcttgtgagacacagggattccaactcctattctcaatcttaaaaagaagttatttttcctcctccaagtgggaattttactagtgcttctgcttccaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcacgcctccttgcagagtgttgtgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggt

SEQ ID NO: 15 - DNA, 2711 bp, Homo sapiens
ggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacaggtaaccattacacccttcaccccccgggccaggctgggtcctcctagaggtaaacggtgtcagtgatcaccatggagtttctcccctgggcactgataaccctgtggatgtcctcaggcctgctactgatcctgcagccagaagttccagaaagtgaagggatttggaggggccgtgacagatgcaggtgccctcaacatccttgccctgtcaccccctgcccagaatttgctacttaaatggtacttctctgaagaagatgaggaggaaggggacaggatgacatagagccactgacacttttctttgccaattctttggaccctgacttctgcccatccctgacatttggttcctgtcttaatgccagtgaaataagatttcgccgcctatcatctgctaactgctacggactcaggctcagaaaggcctgcgcttcacccaggtgccagcctccacaggttccaacccaggagcccaagttccttttggccctgactcagacactattaggactggcaagtgataagcagagtcccatactctcctattgactcggactaccatatcttgatcatccttttctgtaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaaaggcctgtgtgggttccaagttctgggagcagagtgtgcggctaggctcctgggatcgagggatgcagtacagccacagcatcatcacagtctgcacacctcattgccccttttgcaactactgaggcacttgcagctgcctcagacttctcagctccccttgagatgcctggatcttcacacccccaactccttagctactaaggaatgtgcccctcacagggctgacctacccacagctgcctctcccacacgtgacccttacctacactctctggggacccccagtgttgcgcctttgtctccttgcctttgtccttaccctagaacctcctgtaccatgtggtcggctggaccgactggaacccatcattgtagacatcaccaaggacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccc

SEQ ID NO: 16 - DNA, 2117 bp, Homo sapiens
ttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatagcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagatttaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaac

SEQ ID NO: 17 - DNA, 2606 bp, Homo sapiens
atcttataatctataaggaagagatcatattggagaaaaattcattcttcacaaacaaatgccatttatatagtatcagacagatctaattaacaaattgatattgattatgaatatgtgacatgagtaattattctgcctttgttattgcctttgatcaccagaaatcaatacaaggaagttttatttttatatacacagatatccatagcattccaagtttatcatctgtatttctggcctagatctgattccttttattgggaaatgatatttagagctttcagtaggacagtaggaatgccttttctcttccttataaattctacagttgtcaagttttatgaaaagccttgttggaatttaccttggaataacattaaatctgtggatcaatttagaagaaatagtcattttcacaatactaattgctttttttttttttttttttgagacggagtttcactcttgtctcccacgctggagtgcaatggcattgtccctgctcgctgcagcctccacctcccgggttcgggcgattctcctgcctcagcctcccaagtatggctggaattgcaggcgcatgccatcactcccagctaatttttatttttggtggagatggggtttcaccatgttggccggcctggtctccaactcctgacctcaggtgatccgcccaccgtagcctcccagagtgctgggattacaggcgtgagccaccgtgcccagccaattgcttgtttttaatgaagttttctacttttctttttagaggccttgaacatattacatattaaatgtattcccaggcacttacttggtcttatgatactattgtaaatggtagcatttaagttacactttctagttttttccttcattgctgatgtatagaaactatattaaacttccaaagaaagcacgttacactgtttcttttaatttaaaatgtaagtcctaactgttcccaagtttctaaaaatggtttggggaggctagtagtaggtgcctctggaggttggggataggagagatttctgcctttaaattttgccttacatgcacacaaaaaaaatgcaagttaaaagatttctgttcttgatttaaaggccctttaaaagactttattgtattttttttccatttgtttactatgccaagtacttaacatatatattagctcatgtagtttaatccccccaacaaatgaatgaattgtaggttgctgttgtttttgagacagagttggttttttttgagactgagtctctctccatcgcccaggctggagtgcagtggcgcgatctcggctcgctgcaacctccgctgcccgggttcaagcgattctcctgcctcctgcctcagcctcccgaatagctgggattgcaggcatgcaccaccaggcccggctaatttttgtgtttttagtagaggcggggtttcgccatgttggccgggctggtctggaactcctgaccttaagtgatccgcccgcctcggcctcccaaagtgctgggattgcaggcgtgagtcactgcgcccggccagtagtagttttatagaatgagaaaaacacactttaaagcataggtagcttaccctgtgttgaacatttaaggggttgagctccccatagtatgcttttttcacttaatgttatcttggtaaatgtttatgtgctttgctgtaactgcagaaccaaaaatcaactgtttttggcacagtggttaagacaaagaaaggttttcatggggttatatttcagaagaggagacaggacagataatgaataagtaatatgatttcatacagtcatgagtacaatggaaaaataatgagatcagggatagacagtgattcagagatactttatgtaaatggctctctgtaaaggaaacgtttgtgcaaagactgaacaaagtaaggaagtgagtctatgaaagatggtgaaggatgtttaagacagaacagcaagtgagaagtctctggaattaggaatcagccttttagagtgacaaaagaaagaaactttgggttgtagcagcataatgggaattgaagttagggggtaagggaggagccacagtataaaggaatgtctaggcaagtagtcagcaaactatgtcccatggagccaaatttagcccatgacctgcaaggtaaggatgatttttaaatttaagaggttgtaattaagagggaaaaaaaatgacaacaaaggtcttcatgtggcccataaagcttaaaatatttactgtttgacctttagtagaaaaagtagattaagttttattgcagcaatctgaatgagagtatagtgtggtctgtgtgtgtcaaacaggctgtagtggggtttggcacaatggaagtcaggaaaccaagtacagcctatttcattaaccctggtaagagatcagagatcatggcttggttgagagaaatgaaagcagtgagaaatgattagattaagagtaaatttttaaagttggtgtcaataagaactgctgagcaattgaattgcatatgccagaacacatggactattctccatttttagtttcaaaaggaatgtttacctatcatttttaaatctgtaggcatct

SEQ ID NO: 18 - DNA, 2087 bp, Homo sapiens
ttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagtt

SEQ ID NO: 19 - DNA, 2098 bp, Homo sapiens
actgtagatgcgatggcgccgattccaaagactgtggggcggatcaagctagactgctctctacggcccagctgcccactggaggtcgctgctgtacccaaactttgcaaggaattcggtccagaggattacggcgaagaggtaaaagcgaccctcagtttcccccagtcctgctcattttggtcacgcctctttgaagtcagctgtgcagaaacccgcgacggatgggcgccagacggggctctggaggctttggggagttgtagtctccggccatgcccttgaggatcttagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggtacaggtgaggtggctgaagaaccttattcagctggaaccgtgggaggggcacaaggagctgctggggaggcacagggtctaaggattgacacagggtccagtgggagttctctggctctagggtcaagagacctacagtcaggccccatcactgtcaccatgaccccgggtggtttcctgtctaggaagatagggctgataccatcttgtagggctgtcatgaggattacatgagttgggtaatgctaattgcagtgttacctgtttaaacaaaggagaaggatttggggaggctgagacctcaagacctgcttgactttgcaccctatccccaggcatctccgggactgctggcagctgccttacaacagagccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaggctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgc

SEQ ID NO: 20 - DNA, 2045 bp, Homo sapiens
atttgcagcgcaagcagcctagcgtgcggccgcggcgcccaggtcggaaaggaggcggcatcatggagctgaagaaggacatcaacgctgtatctatcgacatgctgctgatcgtgcactcggagaagcggcgcgccgcacagggtacgctctcagaccagcaggcgaacccgagctcgctgctgcagcgcggaggaggattccaaggtgttggaaatggagtccgaagatggcagaaattagaaggaaatgactttcacgaaaacttggtggagaagcagcaccctcagcagccccaggtcatcacttcctacaacagccaagggacacaactgactgtggaagtccaccctcgagatgccatgccccagctgctcaagaagttctccttggctaaacgtttacaaggtgataaaaatggaaacacaagaccccggcaacctggagggaaagatgcccatgcctacccctgggatcgatctagcctgaaatccatgtccctggacctgcagcagtttgagaaattggatatctacacctcacaggtgacagccaagagtggcctagacgaactggtgagtgacctgctccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggctcgccggagtgcagtgtatgaccgtgcctggctactccaagggtttcggctaccagacagggcagagcttctcgggggagtttgaccatgcctggaatgctgtgtacctggagggaagatggcacctggtggacagcacctggggcagcggcctggtggacaccatcacctccaaattcaccttcctctacaatgagttctacttcctcacccaccctgcactgttcatcgaggaccacttcccagacaacaagaactggcagctgctaaaacctcctcaatctctgaggcagtttgagaacaacatgtatcacaagagtgaattctacaacaaagggatgctgagtgcccacccagagacttccatgatcagaacagtgaatgggaaggccacggtcaccattgagagctgcgccccgacgctgttcatgttcatgctcaatggcaagcaagagcatgggctgctgagcctaaggaagaatgggatgaagttggaggtgtaccctccaaccatgggtactcacaagctgcagatcttcgccaagggcaactccgacatctacagctcagtgctggagtacacgctcaagtgcaattatgtggacatgggtgtccagctgcctgctgagcttcaccagcccgtgggccccagctggttctcggagcagatgggcatcatgaagccctcccaccctgaccctatcatccacaccagcgacgggcgctgctccatcagcttcagcgtggaggagggcattaatgtcctggcttccctccacggggatgatggccccatcactgaggagacacagcggcgctacatcttccagctgcaccgggagaagcagaccgagctgaaagtccagctgccccatgcaggcaagtttgccctcaagatctatgtcatggtgctggagaatgccaaccacaatttctactcctacatcctgaaatacaaagtgaatgcccagtgagggctgtgccccggtcttaccctcccaaagggccaaggccagacctccccagggagggctcgaaggaagtgcagggagccctggacaccactgagtctgcatgaaatcccttctaggcctctgcctcagtgtcccacctctgccacaggagctgtgatctttgtgttctgaaggcttcactcaggtgtggctgtgactgagggggcagaggcagtggctctttagaaggaaaaggtgctatgtaaatctaaggtattttaaactgtacacctgcatccagatgccccttctcgtatt

SEQ ID NO: 21 - DNA, 2544 bp, Homo sapiens
tgtccgtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcagcgtggccctgagtggccaggcctgtctgtcggtcggtctaggcccagcacctgcagggcccatccgtgggctctgctcctgggcttcgctgccagccttaggaggcacgtccaggtcaggtggacgcagagtgcgtgccccagggtggtccaggctgggtagggctcctccgcttagctcctccccacctcttcactcaggccttcatcctacaaagtcgggaatcaagacggtttggggctgggcgccgtggctcacgcctataatctttgggaccccacggcgggaggatcctttgaggccatgagtttgagaccagtctgggtgacagggtgagatcctgtctctaaatgtttttcaaaagacagtctcgatctctgtcctgtggtatacagcatccagggaagtgcccagggagcagggcaggcagacgtcttcctgcctttaccccacctgggcccagttcctgcctctgatgattgcaggaagagagttagacgcggaactcccagggtgcagaggcctgcggggtctgaagggcctcctccctctccagtgtggtgactgggctgaggagatgctgggactgagagtgtcatggtggagcctccgtccctgctcatcctctccgcatgttgcttctgctcccgatggctctctctgaaatgcagcacaacctcccaggccaatggaaggaggcccagagctggctccctgcctggaagcaggaggagaccctcacaggcatcatgagaaggcgtggaaagcaggctgccttcatggggggagtgccagggcctgggcacccacgcccgctgacccaagagggcccgggcacctgcgtgctggcctcttcactgaccctcgctctgtctgctctctttgtgtctctctctgacctccagaggcctcctttctctctgccaggaacagtagcccccctgcaaggccctcgttttcctccagcccgcagcctgcggcctctctggttatgctccacagcccagctgccacacactcacctctctctccaggccccccgggttccctccgcctctcttgctgcctgttctctccttttgcaggttgcgtttattggcttatctctgggggttggtgctcttccttgttttcatggaaactgcatggccccaagaggcccaagcagctttgagctgcaagggcaggatcatgcaggccaccgctgccctgccgcttagccacagggcactatttctgactcggtttattagagacatggtgtggcagtctctagaccccacagtcgggctggcatccggggacaggaccaacatccccacaccccagaggcgaactagtggtgagtgtaaagagcccctctccaggggaagacagccagccgggtgcagtgtgctctgctggagagcacagccccaggcgtgacaaacgcctcggcctcttagaagttgtcccctacctggacaggaagtctggaggctgaaacagagactcccaccttcccagagtctgccaggcagtgccacacagatgccatgtgctggtcccatggccacactccagcactcagcccccttgcccgcctcactcctgagttgggacactttccaggtgtcaccaggtgtgatcaggggcctgtgagagcccaggggtctttggtcgcgcctcctgcatgagcctcctgacagcggccacctcactgccacccagagctcaggcccaagagagggtggagagggcctgaaggacaggcctggagtaggggtgtatggactgcaggctgagatgagcaattgaggggcaagtgtccagcaggagggagaaactgggaacagagttcttgtcactccaggagatgttgctgctcacttagcactcactcagggctctgggtgccaggcctagctctcagggcagagggcgtggcagggaagtgagatgatcacactcagtccagtgagaggcagtgaggaaaaccaccagtgagaccagtgtgctggctcacacctgtaatcccagcacttcgggaagtcaaggcaggtggattccttgagctcaggagttcaagatcagcctgggcaacatagcaagaccccatctctacaaaaaatacaaaaactagccaggcagggcccggcgcggtggctcacgcctgtaatcccagcactttgggaggctgaggcgggcggatcacgaggtcaggagatcgagaccatcctggctaacacggtgaaaccccatctctact

SEQ ID NO: 22 - DNA, 2216 bp, Homo sapiens
cacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaaatagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaaggtgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaatagcaaagtcaagaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagtaaagacat

SEQ ID NO: 23 - DNA, 2869 bp, Homo sapiens
ttttttgtacttttagtagagatgggattttgccatgttagccaggctggtctcaaactcctgacctcaggtgatccgcccacctcggcctcccaaagtgctgggcttacaggtatgagccaccacacccggccccacttgctttaggtttagttgactcctgttgtccaggatcttaagacgaaaggtcaggtcactgatttgagatctttcttctcttgagacaggatttcgctctcggaagtgggaagaggtactggggcaggtgggaatgtgagttcaggagcggaggctgtggctggtggaaggcggccagcggaggaaatagaatgctataaaccatagaggaggagggggaaggcagacgaggggtcacacctgtcatgacatgagcaggaagtcagtacgatgcccaaagaggatacgttgaagagttaggataacgctgttgtctaatgacagtgtaaagtggttgccggggaggagggtcagagaacgaaatctgtggctttcatcatcaggcctggtgttccgctcagcctctcttaaccatacattgctttgataacttttaaacatttttggttatctgtggtcctggttgttgtaggttgctaggtctaatgtcataactgtaattacttgctataataaagtgagacaggatgatatccatttgctgtctttgtaaacgtgtgtcaatggaaatcgtcacagaataatggacagtttctgccaattctctattctctctggactatacacagagagactagaacagtgaacccctaagtccccatcacacaagtgaataagattctggtcttcgttgcttctccatgttgtgttgtcgggtttgcaagagcattttaagtcatcacgtcagtcacgaacacttccctgtgcctctctgatgaggacatccgtggtaacctccccactggcgctgtcacacctgacaaggtcaacagcactcccctcgcatcatggaatgggcagtctgtgtccagatggctctagttgaccaaaaagcagcttcttacagttgacttctccccattgactttgaacagattgttattatacgaaagtctccttttttccaccatttcataacctctggtttgttctgtcttcccaggccatgagtgcggctgtgtgctttatgatcgacggtgggtacgcgcctttgtctgatttcagcctaagctttttgtactttgctgcatcctattcttaagtgataaatatgttttgggggtttcggttgtttgggctttttttgttggagacagggtttcactcttggagtgcagtggcacgatcatagctcactgtagcctcgacctcctgggttcaagtgatcttcccaccttggcctcctaagtcgctgggactgccagtacacaccgccggacccagctaatgtttttgtggttgtttgtttagacagggtctcactatgttgcccgggctggtgtcaaactcctgggctcaagcgatccacccatcttagcctcccaaagtgctgggatttcgggcgtgagcccccacacccagcccattaaatgataaatgtgttgtcataagcaatatagaggcatagagaggagccctgttccccatctgggacccccctgtctccttaactagccagtgctcatattttttaagtcctagttttcccgctagtcagcagtagagtgtgggcatctttctgtgtcccaccgactgcgagctggagacagcagtggtacctctctcgggggggttctgaggatcgaatgaggtcatgtctgtgaagcacctggcccatgagtgctacgtaatgtttgttaaataaacatacgaccttctgaggtctttctggggtaggcaaccgtttaccaccctacagggtgtgcctcggtcagcttttcacggtgagataggtcttcgcccttttttttcatctgaaatgtaaccggttttctatcttctgtttctcttctatttgaggagcagaagggggcctgagcattcattgtttgttttcccagaccagtgaagttttcgtttgaatactgttgttcagcgtcgcacagtaaaatgaatcttactggtattttttgtcatgacttgccagcctctgtccacccaacgttggatttttgccgaagactggacagcatcgttgggccccagctcacagtgctggcctctgacatctgtgaacagtttaacatcaacaagaggatctctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagttttt

SEQ ID NO: 24 - DNA, 2314 bp, Homo sapiens
cactaggacacacccaacaccttcttcctggagtgaatctggcagaggtttctttgagcaccagactgtctagaagatatgtatttgggctgttaatgctcacagtgggtcaggaattaggatactgtcaaatggcagcacacaaccaactgttcctctgctctagccccagctggggtaatatctctgtcaaacttgctgtccttcaggaactgccagaaggctgctggctgtgccatggccttgtgctcccggaacacccatcctctcccctggacacacgggctaaaagagggagcaggaagcagaacaaggagggcaacttccacagttctgcatccaggtcaggagcacggtcagcccagagcggcctgcctttatgctgccaagcctcccccgacccccaccctcttaaagaatccaagcaaaagtacctttgaacaatgtgtccccaccccatcagtttgaggatgcccctcatccctcacacgctggaaccttggtggcagcgtgcagtcttagagccaaagtcccacgtggcctctgtgtgcctgactcctctgaaccacccctcagtgtctccgggaggcttggacacacaagagcctcctcaccactgtggtgacagtgcccgatttttgcggcatgcattcagagcttccgccttacgtgccagtggactgcaagaccgtgtgctggagggctgcgggcagacaggcagcagggacttgccaggcaaggcccactggcgcatggcacgggatgcttcctcaggcctatcgccctgcccgcaccctagcatccaccctgggaagggctcccctaactcaggcagtgcccccatcttcagtcactggcaaagaagacaacagagtccagggagcttggacacttgctgcccttggccccaggacaccgatggggagcaggctccctgcaggttactgcacacccaccacacgcccagcagcttctgggtcgccttgctgattcttcccaagcagccgcaaggcggttttcttttgttcttgggtgtttagagcctctgtttacaagtggagcagcccatgtcccaggaagtaggatgtgccactgctgcactccctgtggatgaggactcctgcgctcagcacaggttccctaggcaaccacttctcactggcccagacgtggctttcagagtcctcgcccaggaccctggccagcctgaatggtgtaaccattccctaccccatcaccgcttcaccatggacttgctcaaatcacgcatcttgcaaaataaccagcgaagcaggctacatggagtacttggctcctgcctacctggagctcggcaaagcccggttccccaacacagctctgggcctgaaaggtggcttgccttcctgctaaaggcccgagggacttcgtgggctcattagaggtcatctggtttagctccatttccaagacagactgatttgctggaagccaccaagccagccaccaacactccccaaccccagtgccagcgttctctggccccgtgctgccccaccccatcaggagcccactgagcttccgcaaggttgagtgcagcccacagtgaatacctgctggttctgaacgttccattccttccttgtgaattactcctgatgtggagttgtgtgtgcagtgggagatggaagcaagcctgcagaaggtggtgctcacttcctcggggctaccgtggagctgagtgggagccgtagtttataaatgccctgtgctgcacccagatgctgcagctggaagcagcactcagggagcccatcctgacctgcccgggctcccagaagaggtcaggagccacaggacggtcaagcagccggacaatcacgagacactgcaaacgagctgctcctctgacacatgctagccaccaggtttggaaacctcccagttctgctctgcaaatcaactagaaccttctcccactgctctgagtctgcgctgcaccactgagccgaggggcccactcggcatgtaggctcaggctcaatggcacaactccctgtagcacagcacacacacactagctcccaaggccacctctgggaggctgttagcattgctgacttacacccagttaggaatctcggggcactctgagggaaagtgctggggctgccctgaaaaatgcaccttctcccagaaatcaggggattctttaagacacttgagaaaggacagcagatgatccaaacctctccggccccacctcccagcctagggctctttcctgggccaccctccacctctcccatcaaattaaatcactttcctacacctg

SEQ ID NO: 25 - DNA, 2409 bp, Homo sapiens
catgtatgtgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactttccatattg

SEQ ID NO: 26 - DNA, 2656 bp, Homo sapiens
aggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcaacaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggtaatggggaagagggtttatcaccttcagtctcacgtgccccagcagtcactgcaccctagctcacctgcagtagtggggaggctagagcctggaacctggatgaaggggcctcatcatccaagggaggcagtgctatctgttcattcatccttttgaccaatatttattgagcccaaattcaatagcaggcattgcacttcctactgtggatagaatagtgacttagacttgtgctgtccaatatagccattaattatttatttatacttaaattttaattaattagaatgaaatacatatgactaaaaaccactgaattatatactttaaaaggatgaatttgatggtatgtggatacctcaatttttaaaattaagtacaattaaaaattcagttctggctgggcgcagtggctcacgcctgtaatcccagcactttgggaggccatggtgggcagatcacttgaggccaggagttcgagaccagcctggccaacatggcgaaaccctgtctctactaaaaatacaaaaaattagccaggcgtggtggcctgtagtcctagttactcgagaggctgaggcaggagaattgcttgaacccaggagacggaggttgcagtgagctgagatggcaccactgtactccagcctgggcaacagaacaagactctgtctc

SEQ ID NO: 27 - DNA, 3261 bp, Homo sapiens
tttggtatttttgataccactttattctgggttcttgttgcagagtcatatggctcctttaagacgttctctagtgaaagccattggtccggatgacaaagcaggttttacaattggggagccactctgcccctggatccatgtcccagaacactactaaatgactaaatcactagattacagggcttcactttgctcctaacagtatacctcttgggatgctttagaaaagcttggtgtttctttttgcatgtacaaggtcacgtttgccgctaacgtcttctttttcaactacagcttttcttctgtagtgaccatatgagggtgctttccctgcacccctctgcaccaccccatagagtccaggtttttatgattttgtgctgccttgagattacttacgggttgccacctttgtgctctctgaacagttccttatttcccctccttatagtgctgcactgccttactaatcttccaactgaaaaacacagagcacctgacattgcagattttcatgtattgaattcctatattagtcaccaaatatatgtgtctgtttttatctctcttgtattttcctctctgattttactttggagttaggaatattttttttcccacaaattctctcccaatgacctactttctttgatagcatttgtaagagatgttactttgtaggcttagttacatagtttaagaaacataggaagattttgttaaggcaaagaaagatggtgaaatacaagttacactatcccttattggctctttccaaaaggggaggactggccacagcctgggtttcttagagtttaaactgtattcttggaaacatgttattcacgcttaattttctttccatttgttttggtggtgaaatatctgcttcagagtgaaaagttgatgaattatttcagagaatagggtattttaaggtgtttcagttattttttcatcagaaatttaaggaatagtaaacatatttccaaataaaacatatttcatattacataaagaataacttagtaaatgtatttaaagtaaggtgtttatgtttctttgaaataaaatgaaaatagcattctcaggccagcagaaaaactgaagctattacatgatttggaatcaagtggtcacgtgatttttctgaatcacgatatgacactgtttatttactctttctttttatctttgggcattccagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaactgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctac

SEQ ID NO: 28 - DNA, 2497 bp, Homo sapiens
catgaactttcccagccaacccttcaaccagcctctgggtcaaaactttagtcctcccagtgggcagatgatgccgggcccagtggggggatttggtcccatgatctcacccaccatgggacagcctcccagcgcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatccc

SEQ ID NO: 29 - DNA, 2282 bp, Homo sapiens
ctctgagaatctgagattcagggtgtgtgactgctgtatgtatcttatcttgaactggattgaaagtatcagaaaacttgcacggccaagttgaagattctcaccaagactcatgtgagacttccctctggatgaccagagagctgaaagatgcaggcttgaccaggtacaaggcccatggggaaggaagggcaaagcagtttctgctgtgaaagagttcacccataagctcagctggagtcatgagtcttctaaggaggaaggaaagggccaggcaaggctaatatggtggatccgtcaacacagagcaatgtgcagagcccggcaggatttgtgcaggttgagacagatgggaggagaaaaggcagtctaggagaccaaaggaggcttctccagctccggaggctcaggcatgccagaaagaggcactctctggctccccttggacgacccactgtgtacaaagcacgccgtcattcgccatttttcagtatccttagggcagccctgagagtcacatcaagcgtgtgttatgattcccatttcatagatgagaaaactgaagctcagagacagaaaacgaggtcttcagactccaggtccagagtgtcatcccccaccaggtaggactgctttctttagggccctggactcaaaagagcatctgcagtcggccttttggaccacacaggaccagagagccttggtgaagagtaggtggttagggctgtcaggagcactttttggtgggccagaaaagcagggacaagcacaggtggaccaaggagctgcactccgaggccttgggccaaacctgagggtactgagaaaaagagaggcctttgagaagacagaggtgctcgaattccccaggtttgctcgttaatggagcatgcgagggtctttctcacagccagacccaacctagtaccgatgtgtgaagacaccaagtacagaaagcccttcagtcaccagagatggcctgactccgagctgagggccaggctgccaggaaagccatctgctctcccgggagtccagtgactcagagatccagtctggaagccctgctgtgggggcacaagagaccattcgccccaacattcccggcctctctacggggctggtgagtgcaagcaggagggagtgacagtattggtgaggaatgaaattgcagcggctgtgtgatgctgtaaatatttggtttgaaacagcagagacattcaagataaaagttaaatagaaataaaagcagtcagatgtttattatatgttgccataaaattcaagagcagcctaaaaaggcagatcaggatttgtttaacaaataagagaggagaatgaaggaggtagaggtttgactgtggaagggtgtattttgctggaatctggacagtgatagaagcaaagtgagaatgactcggcccttagactgggagaatgagttgtccttaggtggctgagaactgggggatttccccaggtctcaaggccttaaagggacccacaagtcccctggctgtctgcatttcctgcccgttgcagggggcaagccccaaggggagaacagggtggaagatctgggggagctaaattctgggagcgcaggcaatgcagaagcacggtgcacacaaggatgtccggggaggggcaatgctggtactgtgaggctgatggagcctttttttcagtcctgctccctctccatagccagctcctcaggccaccatcagattttaggcagggctcaaatgaggaactggtccatagtaacacaaaataacccagctagaagggccctttacagagctctgtacttgtctagggggtggcaagctttttctgtaaagggctagccagcaaatattctccattttctgagtcattctgtctctgttgcaaccgctttgctcttgcagcatgacagcccccatacacgatctgtaaataaatggacaaggctgggttccaataaaactttatttaaaaaagcaggctggccaggcacagtggctcacgcctgtaatcccagcactttgggaggccgaggcaggtggatcacctgaggtcaggagttcaagaccagcctggccaacatggtgaaaacccatctctattaaaaatacaaaaattagccgggtgtggtggcaggcatctgcaatctcagctactcaggaggctgaggcaggagaatcacttgaacccgggaggtggaggttctagtgagccgagattgtgctatttgcactctagcctgggtgacagagcgagactccatctcc

SEQ ID NO: 30 - DNA, 2734 bp, Homo sapiens
cagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaaggtaatgcattgatttttgtgggtgtgcttttcctcaagtcctccattgaataagctcatggtagattcctatagcctaggaataaattattctcagattatatgtgtctactttcctctggcctaaatgaaatacagtattctcattatatacataatgagaaggctagagcctgctgtcctctagcctgagtattagaaacacagtcaaggaaggagtgagtttggagactgggcaaggaacgaggctgtgaggtgcctacatgacttctgaattgtgagctgtgtcagtcttgagctgtgtgagttttgaactacagatgagtaaacatcctaactatggcagagcctagaattaaagctagaagcagtaggtatactgaatcttgggttttacaagcccttacatatttgttttatttttttatcatttccaacaaaataccatgaaggaaaaccctaagataagtaatataatagctaacaacaattaagtgtctatgatgtatctcagtgccttatgtttattatatctcatcatgtcttatagccctccaaagcaaataagatatttttcattattaggatgaaaaaactgaggcaaaaagaatttgcctgtggtcacacagctatgaagcagtagattttcgagctctgatttttgacctcatgttcttttaaagattttctttgtgttctcctatcctcagacaatttcagattctcctcgctgacaacatggatgtactgtcttcattgatctagtaaagaaaaattacagtgtgtattacctctgatctgttcatgtatggttttaacagttaggatttcagttactgtttacttcatggcgttccacaacagcagcaccatacagatgaaactcgagaacagaaagctgactttcataagcatccacattctgttaagcaaaaccttagaacttaagccagaaagtattattgagtgatggttggggctgaacttaaatgtagaactgaaaaacactttattacttaagacttacagtaattcataaatttgctcaagaggacgtaagattttaggaatgagatcttgcactgatctattatgtgacttccctgatcgcatttattctgagggaatagttcttatcctgtgcatttattttcttccttgaattattttctgttacatacggtatatagtgtgttatgttgggtactttgatcacgaaaggaagaccagctgactgtgggtgtcttcataccttcagttgtgcatgcaatccagtttccagtagtggagcaaaatgagaatatggttaggcaagtaatatacaagcctctttcttcctttcagaaaaggaaattcttttgttatctgcctcacaaatgttagtatattaatcttatcaactgtttaaagcttctttaatgatcctgtttagtatttttctttgtattttctttcaaacctatatctagaataagttgataaatcttttagaggttataatgtttctattttatatttaaagttggagatatatatatatctatatctatctatatatatatatatatacacacacatatatatatcattaaaataccctaagaatgtaacatagaaaataattttacattaaggaataatcagtgttcatttttaaaaagaaaaattataccatatacgaaacctgtattctgtacaggaatttgaattacactgtgataaaaagaggaagccaagaaagtcaacttgtaatgttcttatcttgttttccctaagatagattgaaagacaaagggaattcacttttccttggtgtcttatttaagatgctgattgtttgggtcacttcattatgttgacaaattccttatttgatatttagtatttggagttaggggaaatgagtatttcttttttcttttttacataactacaactgctgtgtttaagtaaagataccagattcaggttggctgaattctagttctagtttttctctaattcaaactcagtgttgcttgtcttcagtcttcctgttaaagtgaggtggaactggatggtgtatgatgacctcatgtagcctgaacatcctaagaaagttaaaataacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaat

SEQ ID NO: 31 - DNA, 2595 bp, Homo sapiens
ttacacacattgacatttgagaccactgagttcaaagaaagaaaagatgatcataatattcatagcagtcttggcactcacctcattctgccatctcctagctgaggatgggagaatgggcggattattttgttgcctttttgttcctccttgcttattgggcgtgcgcccctatttaaatattaagcaccgcccccctgccgcccgccgccgtacctttaaaagtatcacgttttatttgtctctgtgaaagttaaagatgatagatgtgaaggcacttagcacaggactggccccctaaataattggcagatttgaattcacatcctgcttggtatgaatactgtccacacggtcctttgaaaagttagtagaaaagatcttgggccactgcttcttgtctttccaagttagcatttcctgttgcggccctaccagtgagtcatcacactcagagccttggaacataagttttattactagagctatagtactgggattgttggatgcttagagatcttccccctccagggccacccacactcccctacagtaccacagagcctgccaaggacatggatgcttacggtaccctgaccccatggcttgaccaagtcagggtatactgtttgatgcaaaacaggaactcgctgctggattatcataatacataatgcagtggatgttttcaactgttaggaaacccactaatgaagttagtcgtcttcggcctgtctttaataataattaaatatattagaaaatacacagatccagttctcagctgtgcttgtctacatcaccagcaggacttgcatcttgttctgaaagttttgcaaaggggaggaaagtacttgttgccccctctttttttctatgagtatgaaaaattctagttggccaggcacggtgtctcacgtctgtaatcccaacacttggaaagccaaagtaggaggattaattgaggccaagagttcaaggccagcctggacaacatagcaagaccccatctctaaaaaaaccgtttaagtttcaataaatcctgcataatttctgggattcttgaaagcatgggctctctccgcactgagtctagtttcactgcttcttactggttttaatctttaatgttagacctatgtttatcccttattaaaatttccccctgctttaatttcaatgtaccagggtcaaacatcttataattcacagtgtactctcaaggctggctcatagttattttttaaaattttactaaacatttgatttttctctagcaactgaaattaacctctgaactttttagtgtgtttatttacaaatagagcatttctaagcgagtttttgaactcagcatttcattttgaaggcgtctggagtttaatgttacttggtgatatgagacttccattcttccaggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaagaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatgcttaacgaaaatgcaactcggttttctgggcatttacaaaagcacagtgcaagcaggcaatttggccagcgtggcgctcagggaggggagttgctgaatgttctgtctgtaggtgccgactctcagctacctaggagaagatgccaacaggtatatatcactcactgagaatggttactatccagggcatatagagaattgcaaatcagtaagaaaaagaacccagctctcggggagagaactgggtgcagtcctatggctgctttctcgccttcagaggtgaggcaaacctctttttgtattgcccatgagacttccagaccttgtatggaactaaagacttaggctttcagctgggcacggtggctcatgcctgtaatcccagcactttgggaggccaacaggagcatagatgacttgaggccaggagcttgagtccagcctggacaacatggcgaaaccccatctctagaaaaaatacaaaaattagccagaggtggtggtgcacacctgtagtcccagctactcgggaagcttagatggaaggatcaactgagcccaggaggtggaggttgcagtgagccaagatcatgccactgcaccccagcctgggccaccaagtgagaccctgcttt

SEQ ID NO: 32 - DNA, 2838 bp, Homo sapiens
aaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtctttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccatggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcacaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccacaggtcggggagtaagcacagctgcccctgcctgagaaggagcagcttgcaaggggagccggtggagggaaaggggtacaacagctttgaaatacattctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgat

SEQ ID NO: 33 - DNA, 2279 bp, Homo sapiens
tacaatgaagtcctaggtaaaaaaataaatatcctttgatttcattatgttatttatccaatttgaaatgaattttcatggaaatagaaataagaccaattcatgtgatgtagttttacctgaaatgagggctagattaattatctaagttaggtttgtataatagagcatgggttttaaagtcagtccgccacttatttgtggtgtggtattgggggaaaaaattcaatattcttgtatctgtacttgggataattaactaactatttcctagtgttgttgtgaagatttcatcaagtaatatgtaaaatgctcaacaaagtgtcagcatgtagtaagtattcaacaaacgtcagttctcttctaccctcctcgatattggagtatgtatccatttacagtatatatccacttactgtttatttccataaaaaactgttctctgtaatgcttacaaagtgatggctaagttatgaattattctactcatctttttcaaatgcccctttttttaaaattgtttatttgcttcatttttattaggtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggttcgagtagttggagttacctgtgcagcctgcccattcccatgcatgaatgatcttaaatttcctgtagttgtgctggatgagtgtagtcagataactgaaccggcctctctccttcccattgcaaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacat

SEQ ID NO: 34 - DNA, 2933 bp, Homo sapiens
cccttggccgctgttcccgcaccgcggggcagcgggcctggaggcccctttgagaagtagctttccccggccggcggcacctttggctgcgtgcccggccgcgctcagggtgcgactgcccgggtcagatagcacctcagggcgagccccggcggtctgatctcgccgaccctcctcgtcctggttgcagccgcgtgcgaggccgcccgcgccctccgagtgtctgccggtgcagtgggggtggactggccggctgtggccgtgtgtgcgcgtgtggattggggcccggtccgagccagaagcttaagcggcagatgtcgggcattgccaccctcgccccacctgtcgcgggtggactttggggcagtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgtgggggggatatcattctagagcacgcaactgcaaagaaaacagaatgttgactgttagtttgtatagctttttagctaggagaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggagacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacac

SEQ ID NO: 35 - DNA, 2385 bp, Homo sapiens
caacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcgacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatc

SEQ ID NO: 36 - DNA, 2467 bp, Homo sapiens
gaaaccctgggcggcggcaagctgtgcgacctcttctgcggccggcctgggcaggtgtcttcctcgagaggcaggcaggggatcccggacactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagaaggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctaccgagctgtggacatatgtacgttggtacactcagttgagacgtgttttaatcatcagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgtttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcgcaagctgccaaagaacacatcccaagcagtaatcacagatgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaact

SEQ ID NO: 37 - DNA, 2460 bp, Homo sapiens
cttctcgtctccgttggagtcgtctctgccgcggctccctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaaaagttttggatgaatggaaggaatataaaatgggagtaccaacatatggtgcagttattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctgtagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttaaaaaaaaat

SEQ ID NO: 38 - DNA, 2661 bp, Homo sapiens
tttagctattcttatctcctcccttcagatcctctggcagctagctacgcaatgtgcctgtggtcccactaatctgtgactgctcctgtggaaactccacatcacaattctccaaaatttatcattgccattttaaaaccgtcttttcagctttcaataaaattcaacaccccttcatgttaaaaattctcaataagctaggtattgaaggaatatatcccaaaataataagagccatttatgacaaacccacagacaacattatatggaatgcgcaaaagaagcattccccttgaaaacaagcacaagacaaggattccctctctcaccactcctattcaacaaagtattggaagtcctggtcagagcagtcaggaagcagaaaaaaataaagggtatctaaataggcaaagaggaagtcaaactatccctgtttgcagacaacattgattctatatctagaaaaccccctagtctcagcccagaagctccttctgctgataaacaatttcagagatgtttcagaatacaaaattagtatatgaaaattactagtattcctatacaccagcaatagccaagccaagagccaaatcaggaaggcaatctcattcacaattgccacaaaaagaataaaatacctaggaatacagctaatcagggaggtgagagagttctacaatgagaattatgaaacactgctcaaagagattggagatgacacaaacaaatggaaaaacatcccatgctcctgtgtagaaacagtcaatatcattaaaatgaccatactgcccaaagcagtttacaggttcaatgttattcctatcaaaccaccaatgacattcttcacagaactagataaaactattttaaaattcatacagaaccaaaaaagagcccaaatagccaaggcaatcctaagcaaaaagaacaaagctgaaggcatcacgttaccccacttcaaactatattacagggcttcagtaaccaaaacagcatggtactggtaccaaaaaaaaagccacatagaccaatggaacagaacgaagagcacagaataagaccacactcctatgaccatctgatcgtcgataaaaacaagcaatgggaaaaagactccctattttataaatggtgctgggataactgggatagaagattgaagctagacctcttccttacaccatatacaaaaatcaactcaagatcaattaaagacttaatgtaaaatcaaaaactatgaagactctggaagacaacctaggcaataccatcctggacataggaacaggaaaagatttcatgataaagacaaaagcaatagcaacaaaagcaaaatttgacaaatgggatctaattaaacttaagagattctgcacagcaaaagaaacaatcaacagagtaaacagacaacctacaaaatgggagaaaatatttgcacactatgcatctgacaaacgtctaatagccagcttctatagggaacttaaacaaatttacaagacaaaaagaaacaaccccattaaaaagtgggcaaaggacatgaaagacacttttttttttaagatggagtttcactcttgttgcccaggccagagtgcaatggcgtgatcttggctcaccacaacctctgcctcccgggttcaagcaattctcctgcctcagcctcccaggtggctgggattacaggcatgcaccacctgactgattttgtattttagtagagacggggtttctccacattggtcaggctggtcttgaactcccgacctcaggtgatccacccacctcggcctcccaaagtgctgggattacaggcatcagccaccatgcccggatgaaaagacactttccaaaagaagatacacatgcggccaacaagcatgttttaaaagctcaatatcactgatcgttagagacatgcaaattaaaactacaatgagacaccatctcacaccagtcaaaatgcctctttctaaaaagtcaaaaaataacagctagtaaggttgtggagaaaagggaacatttatacactattgatgggagtgtaaattagttcaaccactgtggaaagcagtgtggcaactcctcatagtgctaaaagcagaactgccattccacccagcaatcccattactgggtacatacccagaggaatataaatcattctaccataaagacacatgcatgcaaatgttcactgcagcactattcacaatagcaaagatacagaatcaacctaagtgcccatcagtaacagattggataaagaaaatatggtacacatacaccatggaatagtatgcagccataagaaacaatgagatcatgtctcaggaacatggatagagctggaggctattatccttagcaaactaattcaggaacagaaaaccaaataccacaggttctcagttgtgagtgggagctaaatgatgagaactcatgaacacaatgaagggaacagacactagggtctacttgagggtggaagatgggaagagggagaggagcagaaaaagtacctattggtgatgaagtactctgtacaacaaacccgtgacaagagtttccctatataacaaaccttcacatatacccctgaacctaaaagtttttttaattgtaaataaatggatcattaaaaaaaattttaataat

SEQ ID NO: 39 - DNA, 2485 bp, Homo sapiens
cccttccttcccctttcccgcagtcgttgcctcctcctcccctgcctcctcctccccttcctcctcctggccgcttagtctcacacccgccgggccgttgttcccgagacgttgttgagtcccctgtgtcctcttctggactacgccaagccacaggtggaggaactgcaatgtctggtggagaacagaaaccagagaggtactatgtgggtgtggacgttggaacaggcagtgtccgtgcagctctggtggaccagggtggggtcctgttggcttttgcagaccagccaattaagaagtgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccagacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacgctaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtgggcctgtcgcaagaggtggagtccgttcttgtgggtgctgctgttctgggtgcctgtgcctcaggggatttcgcttctgtacagtgggggaaatagatagctcagttgtggacgatagcagcaatgggaagcagtatttgagaagaaatcagactctcttcttccagtcttttgcaagacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttg

SEQ ID NO: 40 - DNA, 2937 bp, Homo sapiens
gtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagt

SEQ ID NO: 41 - DNA, 2493 bp, Homo sapiens
agagcccggcgcttgatctgggctggggggaggcggtggcggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacagtggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgtttattgcagtagtatcacctagcagaggggacactagttgaaaactagagagctgctgtcctctgtattctacaggagcttttcctgctggtgccactgggttccagtagactcatcactgcagcctcagcagggcaggccagggatctggacaatggggactgtttagttttttgtttgtttttttgccagccagaacttttaaaaaagtaaacatccatgtagaatgattaaatggaaagttgcttctt

SEQ ID NO: 42 - DNA, 2442 bp, Homo sapiens
ttcaggtcatctgggagaacttaaattcttccttctgctattacaattcttctcactcagttgcctgcctcttttttttttttaatttacttgtgactgagttgaagcccagcattttactttccttaatgatctgactttcataagttgataagtcatgaaatcattatcttacattatatgagatatgagataaatcataaatcatatgaaattgataactcatatgaaaaccaaccccaccatatgttcactgtctacttgtgtccatcttcgtcccacgcaccccacaaggaccttccccgccatgtgcctcaaacatcagttcctgactcagggcctttgtatttgcagtgcccgttgcaaagagcacaattctttattttatctgtggcttgtccgtcatgtctttttttccatgacacctccacacaggccttccctgcctgcctggtttaaaattccagccccttacccttcctcctttattcttctccctagcaatttccaccatgctgcctggtgtattttcctcatttctctgtggcttctacactagaaaatatttcccttttgttcaccactatgagtctagacccatgactgccatacagcaggcattccataaatgcacctgtggagagttgacccatgcttgttgcgtgacttctgtctgatttttttctgtgttgcagcataagaagcgctaatagggagaaccaacttggctaaaacacaccaggctttttcacctctagtctgtacctgggctgtatcccttctcaaccctaaagctaaaaagtcattgtgaaccttttggtctgatgctaaagaagggaaaacaggtacaggaaatcccatttggatgcttgcttccaggatttcctgccatgattccagaatcccacagctccaacatgattgcaaaagactccctgctcatttttcctcagcatgcacagcgctgccctgtctcagttgcaactcgacagagccgcatttactccagaacccaatccacacacctgctcatcctgccccgagaggagtgcctgaagccaatagcagggaactagagcagacttgggtggatcttcattggatattaggtatcttgccctagataggcagcagtggccttacagatgctgacagatgatctgattagatgcacagttgctgggtggcgtctggggccagtctattggcagttctgggagtgggaactatttgggctctgcaaagatggtttcacctttaagaagggcagtatggggaggtgaagatggggcccaaaggatagaacatagtcaaagaagcagggccacaatgcccctttaattcccaagccctagttgagcagtgcttggtgacacatcccattacctcaccttagatcaatgtctactgagccatcattagctctgcttcctcacttcttcacagtatctgatggcccatcacatgctgctcaacatcttagaccaatgtctgctcacccattacctcccttcacctcatccagcactgtatctgaagcttcactattcttccttcagttttggatattttgtgatacaacattatccccaacttaggacaatgtcagctgactctcaggagggtgcctggagatcacctcttccttcctaacataccctagaacaaggtctggtccccttcattattcccattttaccttactcctaagtgtatcactcctcatgaattccaggaaatatggaggaaaacacatttcactgtacatgactttcaataatttctcctttatatttattgtaacgtgatattttagtgctgacatatatatgtatatgtatgcccatttatataaaagactagtttttagagaaattttaggttcacagcaaaatggggcagaaggtacagagatttcccatatatcccctaccctcacatatacacagcctcccccatcatcaacatcccccttcagagtggtacatttgttacaattgatgaaactacattgacactatcggccaaagtccatggtttaattagggttcagtcttgatgtgcattctgtgggttgagacaaatgaataatgacatgtatgcattattacagaaggataaagagccgtttcactgtcccaataatcctctgtgtttcgcctactcctctaaactcctggctattttcttttgtctccataattttgcctctgaaccataaagtatgcagccttttcagattgatttgtttcacttagtaatgtggatttaagtttcttccatgtcttttcgtagcttgctagctctttttttttttttttttttctcattgaataatatgctattgtctggaagtaccatgacttatttatccattcacctactgaaggacaccttaattgcttccaagttttgttgattatgaataaagatgctataaac

SEQ ID NO: 43 - DNA, 2338 bp, Homo sapiens
agtcgctgacagccgcggcgccgcgagcttctcctctcctcacgaccgagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatacatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccatcaacaggtctttgaaatatgcatgtactttatattttctatatttgtaactttgcatgttcttgttttgttatataaaaaaattgtaaatgtttaatatctgactgaaattaaacgagcgaagatgagcacc

SEQ ID NO: 44 - DNA, 3225 bp, Homo sapiens
aacttgaggggctgtgcggcggagggcggctgcggagcgcccgcgcgggctgcacctgctcagggagctgcccctctgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagccgctgctcacccccaagaggctggcctctctggtcagtccttctcacacgtcctccaactgcctggtcataaccatcatggaggtgcagagaaagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctcttttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagctgttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaagaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttcc

SEQ ID NO: 45 - DNA, 2252 bp, Homo sapiens
acatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagccccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaagcagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagcaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttct

SEQ ID NO: 46 - DNA, 2186 bp, Homo sapiens
agtggcgggaggctgtgagctgagcggtggggtctgcgtacgcctggagtccttcccagctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccagaagtaactaaaattccagaagatattctccagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggactattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgtgagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcataccgtggagaaccattaaaaatttgagaag

SEQ ID NO: 47 - DNA, 2717 bp, Homo sapiens
ggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctc

SEQ ID NO: 48 - DNA, 2381 bp, Homo sapiens
aattcagattctttccttagcttctatttccccatttgtaaaattgggatgatgaggacatcttccttgggtagctgtgacaatgaaaatgggatcatcatgcatcagccttagccccacgagtgccacagtaaactctcaaagaatgaagtggggtttagaccctaaatgcttcagtgtgagctgtgaagccccacagcttggctggatcaatctggacttcgggcagatgcgcactaagggctgcttacctagaggagccacgtttctcctgggcagtcaagataactgccagaggagccacatgctgggtaaatcctgaacccaaagtggaattttgccctagtataatgggttcatattcgattggctgcacttagctataaatcctgaggaggagaagaagaaagacatcagaaagtaattggactagaagaaccttagtttggaagcaaaacacagaatccagaaactatgaagaaatttacatgcacacatatgtatacaagccatgagagggaaatgggaatgtacctgagagtgtcgtcaaagcgtacagtggctgcacagtgaaatattatgtttgtacaggagagaagctcctgcatgtcctctttgctgatggcaaagtcattctgattgagatctgcataaatagctctgatcttctcatgcacatttggacaaacttctttgactttctcaaatagctgaaacataaatatagatcaatatacaaaaaatagcaccatcattatcacattgttcttgtttataacaacctgcttaattatactcaaaaactggttttagttgtaataacattacttaaagaagacatctggctgggcatggtggcatatgcctgtaatctcagcactttgggaagccaaagcagggagatcacttgagcccaggagttcgacaccagcctgcgcaacatgggttctgtggactctttcactttggcctgtgaagacttctgactactggaaagcaagaagtaggagatggtttcagcatccacccttctcacgatggggttccttacatatgataatctgatgcctaccagaagaaactctgacccagacaggatcattgcataagaggttggttttagaagtagagttggctgaaattaaagtctcgagtgacatgaagacagtgttaaagataaatccaaactcttctttattgcttgacacttttccaatcagcattgacttcattcctggcaagctgatgtaacatgaatgagttatgaagccaaagatcgcaagaagagcacacttcttaacagccacttcagaggtgacagccagggaataagaaataaggaagaactttccagaggatggagccaccacaaataataatggaaaagaaggttcctcccagagattagatttagaggctatttaaggaatttccccactcccagtgtaggaagcttctcaatactcgctaatcaggatttccttatggttatattctagggactgctgcttgcctgcctgtcttctctttttttgaatagaaggtgtctttgtttgtttgattttattttttcttcaacttcgctgttctacaatgacaagagatagaacagagacattttctacctcaacattgggaggcagaaaattcacctttttatccaagaataccaaaccagaagctgaaatatctggatctgatagagaggatagtctattcccccttggactttggactggatgcaataatggtatgagaccctggggtgggaatgagtgtcttctatgtgtgggaaagagaggaaagcagatatttggcgacctaaaaagaaggccatggcagaacctcattagttgttcaacaatcctattttccttttctcctggacacacagctatgcattttccagccatccttgtggttagatgcccagtgacagttctgagaatggaatatggacagatgtgataggcacttctgggcctgggccacaaaaaccttccacatgatgtccagtgcctcttttaccccactgacagttttttattgtcatccagagagaccttggatggtttagaagccatgtgtagaagatggcaaccttcccttagcatggatccttgaatgactgtggagtgcaatgccttctaccaattacacctactgtgtttgagaatcaaatttcatttgtattaagctactgatttggggggtttatctccttcagcacccacattagtacaactcatgcagaatggagagttaatgtgaacacatatggcacagactggtgaaacctaggactttaagatgatagatgaatttctgattatactttcctttcccgcaaaaagtttttttcaaattaaatgttgtaatat

SEQ ID NO: 49 - DNA, 2258 bp, Homo sapiens
ggaacgcgccgctaggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagcttgcttttcaggaagggggcgggcaggggagcagccgactcccttagcgccttcggccccggagggactggaggcctggaggggcctcagcgccgccgtgcccacctgtccgcctccagatggcctaccaggtggtggagaagggcgcggccctgggcacgctggagtcggggctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttggttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctg

SEQ ID NO: 50 - DNA, 2552 bp, Homo sapiens
gctgtggctcctctctcaggggacagcgtaggccctgggggtcagttggagagggctctgactaccagcgactgctctgggggtgtctgcgatcaaggacgatcctgggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaagcctggcattcttataacaccacgtggcgcagcaagcagcaaggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaattaaaaaaaaaaacacttgtaatctcacccctcctaaagttaatgttaagattttgctgtatataatgaatgtatattatgaattatttacaaaaatggcatcatagtatacaaactgttgtgacttgattgtttatcactctaaaatctgtccagaaatattactttaatgttcaaatgattgccatctcagcactgtcccatacctgatagataaaatcaatctggctgggcacagtggctcacacctgtaatcccagcactttgggaggctgaggctggtgaatcacttgaggccagaagtttgagaccagcctggccaacatggttaaaccctgtctctactaaaaatatagaaactagctgggcatggtggcgggcacctgtaatcccatttacttgggaggctgaggcaggagaatcgcttgaacctgggaggtgaaggttgcagtgagctgagatcacaccactgcactccagcctgtgcaacagagaaagactccgtttcaaaagagaaaagaaaagaaatctatagataacaatccttccaggttgtaaatattattagccaaccacagaaaagcatgaagtgggtaccaagtaaatgagcacgtacactcttctgacactttagtctgaatttagtctgacaactctgactaaattcaacttactttagtcaatgaaatacctcaaagaaatattacatgtttattttttatttatcttctaggtaactcaatatcgtcttttttataataaagattcattttactcttaactatgttaaaatgctaaaattaattaatttccatttatttggggataaaacatggcttaagaac

SEQ ID NO: 51 - DNA, 1709 bp, Homo sapiens
attgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatg

SEQ ID NO: 52 - DNA, 2631 bp, Homo sapiens
gcgaagttacagaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggaggagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcgggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttgcagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagagtaagacaagggcaagaggcacctggagatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggggcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagaggttgcaaggctgcagaatgtactagacctcactggaagtgacaacaaaggaggctttgaaaatgttttagaagaaattgctgaacttcgacgcgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatgaccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgc

SEQ ID NO: 53 - DNA, 1769 bp, Homo sapiens
aaaaacggagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 54 - DNA, 3324 bp, Homo sapiens
gtgcttctgatgacccggccgccgccgccgccctgcaaccgctccccgggacccctcaacgctgacactgatgacccgcggcgggggcgctgggcgcggggtgcgcaggccactggccgcgggctctcgggcccgctcctgccgccggcttctgctgcttccgcgtgccgtggacactgccagaatttgtcaaaggtcctaggaagaaaaggctctttcacccctcccctcaatgaacagatggcgtgtttggactgttcgcattcgctcctcatagggacaaatgaatctcttcccacgccatgggatttcccttgatttttatattgggagtgaaaagatgaagcatgagactcttcagctgcatctcgaactgcatctaatcccagcacatctctctcaatctttgattaagtctgttcatctaaaagagggacacaggggaaaaatggaaatgggactttggaagaatgaccatccacattcccatcacagcctgagatttcctacctgattgagattttcagtagatggccctaggtctagtttcccactttggacctgctgcccttggctccaatagaggacttccaagtaactaggaagatttcacctctcttttgaaacataatggacaaatgtgtttctttaggatgagaggtgcacctggctagtcaatctttattttcctaaaataaacaggatgaaaactcaaaacaaaaagaaatacctcatgggcaaaagctctcccaatacaactaatacagacactcaacatggctttgtagaaactgacccctctcccaagtcttatgtttgtcagaattgcatgcctatttcaatcgaagaaaagtgatctgatctcttcagatgaaggtgggacttggagatgctgctgcctagagttaacttgccagagaaaggataagcattcgggaagtgccaggatggggtatcagctgaacaatggcaggatcccttctgccagtgggctggctcagggagtaaacctccccggaaggaattttgtttctctctagaatcaaagtgggcaaaatgatcaccttattcgcctggagtgaaccaggttgaaactgagaaggcagacatgggtgataagccagatgaagtcatatgttataactaagctatgtacctgtaacttgcctggtagttttttcattctctctaaacaggtcataataagtgttagtctgtgatccactatggagagagatttctggaaagaatagaggcagtggtagagggtccaaggttgttatttaaggagatgaatgtgggtcaggtgccgtggctcacacctgtagtcccagcattttgggaggcagaggcaggaggattgcttaaggccagagttcaagaccaaactggccaatatagtgagatccccccccccatctctacaaaagatagaaaaacttagccaggcatggtggcaggtgctatagtccctgccaccatgggactacagctcctgcagtcccagctactcaggagttgaggcggaaggattgcttgagcccagaagttcgaggttgcagtgagccatgatcatgccactgcactcctccgtgggtgacagagcgagacctgactcaataataataatattaataataatgataatgcaacacaaactatcttttacctcttgaacaatgaatgcagatgccatgactacatctgtttgttggggaccagggaggctgccagtgaggattcagggtggaagtagtgtgtacccaatacctattgtgagatgtggcctggggagccctgagattgcctggccaggctcactcactacccagacaccctcttcctgcatggcgagtccctcagcccctccaaggctcaattctcagacatcggagtaatccacatcctccatcttgagttactcctcacaaggcctgcaagttttcctaggaggaagggaagacagggttgaacccacacaattctagaatctagaatttggcggatttctaaaccatttctgtaagtcagcccttgagaacttgtagattttctcatcatttgcagcatgagagtctggagtagactgtttggatttgactcttggttccttgggcaagttacttaacctctcagctgtgtgtcagtttccttatctaaaaagtgtggttaataataactgacctctcagaggtattgtgaggttactgtgatgattaaattagttgattcatataaaatgtctaaaagagtgcctggcattattattaatagtaataagtttagcataagtcttgcctgccaataaggagctggattgaatgactactttgattctatttcttggcctcctcttctctggactaggtgaccccaactttctccttactcctgaaaaatttatcccagtctgctaaggaagagaaagcccatgtgtgcacatacacacatgcacctacacaaacatttacatacagttttgctcttctatacagagttaatagagctactagagtgtctaggaaccaatctgaaagagaaaggaaacactgcttttttttttgtttgttttttgagatggggtctcactctgtcaccaggctggagtgcagtggcgcaattgtggctcactgcaaactccacttccctggttcaaatgattctcctgcctcagcctcccgagtagctgggactacaggcgtgcatcaccacacccagctaatttttgtatttttagtagagatggggtttcaccatgttggctaggatggtcttgatctcttgacctcgtgatctgcctgcctcagcctctcaaagagctgggattacaggcatgagtcaccacgcccggccgaaacactgcttattacaatttataggtttatgttcaaaaagttgctaatcttattgctgtgaacccctgccatctctagtcctgcccacctataggtactgcagaccaaattacagattcagaattgcccagttcctgttcctgtcttgaccaatcctagtaacttatttggggcccagccccatcttcagtggaaggtctaaaattggccttgcttccttaagctgggtacacagtgggcccaggactaagcctcatgaagcttttagaggcccactgagattaacctttctcaccagtgctcaccttgtcttcctagtgaccatggctgccttctgtctagttctagagttgcactctaattctcttccagcgctgttgccctgatctacatatctatctcttttagaactttccagcttatgtgtccaatgtcagtctttcttccaaataaatagaactttatcttg

SEQ ID NO: 55 - DNA, 2278 bp, Homo sapiens
attaatgacccggagccacatgacggagcatgacacagcacttttgggcacaaggcagggcccagaggggtgcgtgggggccgcagcccagcccccaagccccgccagcggctttactggggtgtaacaaacacacgataaactgcgcatattccagtgttcatgtggatgagtttggacatatgcacacacttccgaaaccaccagcacaatcaagacagcagacatatccatcgcccccaagggtgtccttgtgtctttttgtcattcatccctcccggccgccccatccacactcccatcgcctgccgactgtggctgatctgctttctgcggctgtggattagtttgcgttctctacaattttctgaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttgctccatgagggcaggggattttgtctgtttcattcacaatgtgttcccagagctcagcacagtgtcaggcacacactaggtaacagcacctcgacttcctactgaagaaccccctcttcccttttctcagtccatgaggctgggggtgcccagaggcctctgtctccaggggtggacatgtgaccgggtcttgctctagtgattggtccagggatgggcacatgactgagcctgcccaatgaaacttgatcttgggacttcagggttggccatgatttgtgaaggagatgccattttccattggatggacagtgagcaagtgaacgcttagagaagaagaggacaaaacaagggaaaagcctgcctgacaggaagcagcacagagctggacaggctttgaactcctggatcccactgtacctgaaattaggcaccttcaactttctagttatgtgagccactgtctttcccatttttggctgaaaacagttgggactggctttctgtcccttgcatacagaaggtgctgactgacccctgccccatggaagaagatactccaggcagaggaaatagtgtgtatagacactcctaagcgaatgccaagcggggcactcatgtaccaagaagaaggaggaggaggcacctgggagctgagcttaagagttagtcgggtggtcaaggtgggagaagggggtatctttagcagagggaacaaccattgcaaaagcttggaggggtgactagttagtgaagatcaactgtgtgctgagctcgtgttgggtggcaagggacacagacgaaaagggcacggtggaacccagctacttctcacctgctccagcgcagtgcaggcttgtctgcttttggagccgagcctggacacctccgtgtccttcccccggcagagtgctgccagcacgctgtctcagactctccagcatctcctggttgatgtgcatcatggggaccacacaagattattttataggctgcacaggcaaagcataaaatcacctcgggtcacatagcgagagttattctctctgcaaattctttacagtctttcctttatatccagaagagtctctgtgtggtgctaacttgcctcgaagaccaaataattgctagtctccctttgtgaaaaggagagcaggtgtcaggctcattcatgtctcaggcacacaattgtatctagctagacttttcaaaatgtcctatagagctgcagcacatatgaatgaggtgtccagctggtcccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgc

SEQ ID NO: 56 - DNA, 2066 bp, Homo sapiens
aactcaggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagctctgccactcagagcccacgagagtgccgtctccctaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcatttagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatgtagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttccgcacaggcactttagcccgagccaggcacacctgcgagggggcaggtgtgctccgccgccctgctgataagctggcttcattaaactgacacttctc

SEQ ID NO: 57 - DNA, 2507 bp, Homo sapiens
gctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacggagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcggagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctg

SEQ ID NO: 58 - DNA, 2171 bp, Homo sapiens
acatccgccggttaccctcgaggctccccggccgcgcgctcccctctctccgtcccatcacccggtgaccccggctgagcgaacgcccacccctccctcagggaccccctccccgtgacacgatcccccgtgaacgcccacctccctcagtgaacactcccccgtgacatgaccccccgcaaacgcccacccatccctcggtgaccctgcgcccgtgagcgcccacccctccccctgcgacccctccccccgccacctggcaactgccgttttcccgccttccctcctccgccccctctcccgcatcaccccgttttctggtgaccgctcccccccatcccgtgacacaaacccccgacctcccagcccttccccggtgacacgatccctgtgaccgtctggcccggtaaccgcccctcccctcatgacccttcacccagtcccctggtgcccacccccgtcactgccgcccgcctggttccagcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctg

SEQ ID NO: 59 - DNA, 2139 bp, Homo sapiens
gacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccctgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggggcccgaggagcccaagaggcctgtccccgcagagcgcggtggcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcctagagcatggacctcctgccctgggggtcatctggggccagggctctctgggtgccttcctgctgccccagccagggttggagtcttagcctcgggatccagtgaagccagaagccaaataaactcaaaagctgtctcccc

SEQ ID NO: 60 - DNA, 2419 bp, Homo sapiens
acagcctttgtggggcctacggggcagtaggagacaggacgcttgtcctgcggaatggcaaggaatcagctccatttcagggcaaagtggggcctggattgtgggccttgaacatgaaggcaggtgggcgagggactaggggaccgcgtgaggcccgacgtgcacacggcagggcccggcacccatggttgcgttcggtcggccttggccggctggctcctgcttggaaacttgctgggtggtgtctgcgggaaacagtactgagtctggtgaggaggcaaacgctcagaatctactgcaggtgttagttctgcagaggagtcttcctgcttaagggctcatttgatgttctggaaatttgccaggtactgaaatacagccagtcttcccaaagattcctccgctcctctgagtgcacgtgtgtgtgtgtgtgtgtgtgtgtgtgtgtgtacagccacacaacctgactctgtgttcacacacacgggccctggccaagtgtgagggtctccacgtgacaaaggaaatgagtaaacaacttcaacattgttgtttccctctgaggcttgcaaagaaggtgttaagagcacaagatttaaatcataaactttattaaaagccaaacagcccaatgtgcgattcttgccaacttggacagagtctttggggtaatgctacacggagctaatccagaaggaatcgagtggaggaagacggcagggtgggggtgagcccacgcgtccagccaggagaggcagagggaggcacagccccgacacagccacccaccctgtggccagagcagggtggcgcaggagctggcaagacctctaagctgttcctgcttctgctctcctcacactgtttccttagcaaatggagcctccttcacgcctaaagggcccagagcaaggcagggggaggagggccgacccctgcaagactgagaactggccagaattgcccacttgctagactagcaagagagcgaagtcccagtgggtacccccgacgaaggacacccgttccttaccccccacccagaggcacccttcctcctccaaacacaagatgctgctccagcaggggcagggaccatgtcagcctcccacaagacacacacgggaaagccctgcttgtgagggcgccacacccagggcaggaatcagaatgaagacacgactccacagtgagcacggggctcgggacaggacccagcgtggcagaccagccagagaagctttcacactgcaaacagcccgctccacctacaccaagagcgaaactccatctcaaaaaaaaaaaaaaatcaaacatagaattaccctgtggtccagcaatcccacttctgggcacatatgcaaaattattgacagcagggtctcagagagatccttacacccctgtccatagcagcctcattcacagcagccagaaggtggaacaacccaagtgtccagctacagatgaacggacttgtgaattacggcatagacatacaaatgctattccatctccagagagggttgaagttccgacacacgccacacaaaaatgaacctcgaagacatgctgagtgaaacaggtcagacacaaaaggacaaatattgtatgatcccacttagacgagcgacctagaacaggcaaattcacagagacgcaaaggagtctttctgcccatgttcgcctcatctaacccctgcctgcagggtctgggggaggtcagaacgggcagttagggttgaaagtatacagagtttcaatctgggaagatgaaagagttctgagatgaagggtggtgatggttgcaaacagtgtaaatgtgtttgatgccactgacctgtacagttaaaaatggctacagtgataacttccgtgttgtgcaaattttcacaataaaaacttaatgaaaggtagctagagacagcaagtgaggggaagcgaggaagggcgagttattggttgaagggtagagtttttgttagggatgacgggcgaagttttgggtacagactgtggtcatgtttccacaacatcgtgaatgagtttagtgccacagcattaaatgtattcatggtgtacttgtgtacttatgaatggctaagatgataaatattatgtacattttaccacaataaaaaagtaatgaattctggccaggtacagtggctcacccctgtaatcccagcactttggggggctaaggcaggctgatcacttgaggtcaggaattcaagaccagcccggccaacatggcaaaaccccatctctactaaaaatatagccaggcgtggtggcacatacctgtagtctctgctatttgggagactgaggcgggagaatcgcatgaacccgggaggtgcgggttgcagtgagccaagattgtaccactgcactccaacctgggttacagcatctc

SEQ ID NO: 61 - DNA, 1980 bp, Homo sapiens
tttcccgcggctgttcgctgttccagtgggtcgtggcggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccacccaccagtggctgtcctgcgtgtataaggaccacagcatctacatctgggatgtcaaggacatcaatagagtgggcaaggtgtggtcagagctcttccacagctcctacgtttggaacgtggaggccctgtcctaggtgctgaggacacagacacaaaatccctgcccttaacaagctcacatttggatgggaaaggaaacctggaaacatcatcagtgaataacacgccaagcagcagtaaccctctgaagaaaaatgaggcggggaaggggaaggggaatgcaggtggtattctagagaggagaggggtcagggaaggcctccctgaggacatatgagcagagacctgcaggaaatcggggagtgagacctgcaactgctggggagaaccacaagcacagaggccctgcggcaggaacatgcactccacagagagctttgctgtggaggtcgtttatgtatttcactgctttttttaaaaaggagttgaagacggggcatggtggctcacacctgtaatcccaacactttgggaatcttaggcgggaggatcacttgagtccaggagtttgagaccagcctgggcaacacaagaccctgtctctacaaataatttttaaaaattagccaggcatggtagcacacacgtgtggtcccagctactcaagaggtggaggcaggaagatcacttgagcctgggatgtcaaggctgcagtgagctgtgattgtgccaccacactcccacactccagcctgggtaacagtgagaccatgtctag

SEQ ID NO: 62 - DNA, 2353 bp, Homo sapiens
gctttgcctccaccgatctccctgtggggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaaccatccatttcaaggccaatactcagtatcagacatgaagttaaggttctcacattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttc

SEQ ID NO: 63 - DNA, 2068 bp, Homo sapiens
aaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcattttcggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctaggttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgcgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcattgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtccttgatccagtcaaccacttcaaattcctacactgtctcaagagtattaaaaggattatatgaagtaataaaggataaaatgcattgg

SEQ ID NO: 64 - DNA, 1977 bp, Homo sapiens
gcttccgagtggcgactgcagcgggtccggtgcaggtgaggggcgcgcgcctgcccagctttgcagcccccgaacgcggcctcgcacaggagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtcttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccgtaagtttcctttattaataaacaatttgtgagtc

SEQ ID NO: 65 - DNA, 2490 bp, Homo sapiens
ctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagccgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtg

SEQ ID NO: 66 - DNA, 2320 bp, Homo sapiens
gctaatgctgtatatatggcttacgttcaggctctcctgtgcccagagagagaataaagccatgttgaaaccgtccacaattgcttaagtgtttttccagctaccgccactcgcctgactccccttggacctcagttagaacctgacatttggcgccatgaacagatcctgagatttagaagcagtggcgcccttcttgtggcaacatttggctgcatgtggttgggccatcaacaaatccaaggtccaacagcctggattatctgcgagattcctgggagttatctggtcagatacaagactcaaaggaaccatgcggagctgataaagtgtggcaccatctcccagggcaaaaactgttggcatctgcattgttatccagagatgaaaggttagactgtattttgcctgagggacatgatttaactctgttagtacctgtgcctgctctgtcatttcgaccgtaggttgacatgctccaactgcattgtggactgggcccacaccttcactgaggtgaccaatgtttccaactgttggatctgcaccatccttccaggagcagctgcagatggcttgccttggcacatacattcagcatctgcagagaaatggacatggctggagactttgagtcccatggccgacacctggaatgcgacagggcaagctgcagacaaagaattccgcaagacccatagcatgcctgccccatcttgcctgtagcatttatgatgggaggggctggctagtggggaaatatgtagtacccccagctcagggacggcagtgcatagaggaacactggggtaacaccactgtgggatggctaccctgcaaggcctgtgtaaacataacacatgtcaccacaccgaaggtatggtggaacatgcggccccacccaaggtcaggccctgatggattttatgacccctgggagtttatgggtcattgaggacacagggtgtccttacctaccagcagactggcctggacgttgtacctgagtttggccttacgtacctggcactgttctccctgctttgcccagatgccagaataactgggaggtgctatgctctcactttttgtgagtgcgatgaggcccctggtggttcttcaccttggaagtgactatccctggagtgggtatcataactgtaaaagcagaagttactgcttttgcagagcacaccgctcgggctctgaatcacacccgaggggccctcctcctgtcaattgatgcagttgatcagatcaggaaggtggtgttgcaaaaccgaatggccttagacatagtaactgctgcccaaggaggcatctgtacccttttaggaacacaatgttgtacctttatccctgacagtcagcagaacataacagcagcccttcaaggggtctcatgggagaataagtttctagggagccttactgatgaacccctgcagagaaggaggggcatccctaggctctggcctatgctgggccccaatagttataaatagcgtaactgggatcctagtagctgttgctctctgtattgttattgtgggttatagattcagggctctgctgtatgggcacatgtctctgcccggaggacactcttggcctagggagtggagggtaaggaaaatggctgcactttagtcaggaataagctgaggcagccttccaaagcagcataactcagtgggtttggagcacaggtgcacagccctgcacattatgtaaccacaccatgtgaggtgcattaggtgatcacacacgtgcgctcatgttttgctcagaaccactattgtctgtaaaaggtatggttaccctactaaagctgtacatatggctcacccccaggctcactcatgcccagactcactcgcacttagagagagtaaagccaagtcaaaactgtctacgattccttgagtgtttctccagctacccgccactcaccccaccaactcccctcggaccccagttaaaacctgacaccacccctttccctgtaagaggagtgcattcctgcccactgccatgcagctttctatgtccccagtgggaggcccatgcatccctgtcccatcggcttttggctttgaccaaaggaacaaaagcagacatgacagaggccacatccaagtagaaactctaagaggcaggacaggtgtccacagtactcctggtctttctttctgctatgagaatagcatatcccacttaggaagctgttccttcagcttaagtccctgaatgggaaactgctgcagccaaagaaagcttcagtcaatgcatagtctccctttaataaaccttgtggtag

SEQ ID NO: 67 - DNA, 2005 bp, Homo sapiens
atctgtcattctcacgatgtgccaccgctgtggtctggactgtttgcgtgaggacggcgagctctccagccacagggctgcaggcaggaggggccccattgggctcggccaggacctggaccagctgcagccaaggccttcccgctcaacacaggaggtctttttcagcggccatgtgtgagtcaggagaactgggaatgagaatggcacagggcccaggaaggaccggagggcggcgatgtgcggaattatttatacaccagccagaacacattgcagcaaagttcccagaaaatgcattcctcacagcaaagggggctgcctcattgcacgtggaaggaaactcacttcccacacatcggagcccagacaatccgcctatttcacacaaacccggaggtgctgaaggttatgacgagacctcatctggacgtgaagggcccctcctgggtgggacatttccctgcttctggtcctagagtggcccccgtggggctgacaggaaggcatcttggtggtgggggggtggggtgcgtgggtggggcagggtgtggcccgactatgggtcctggtgtcgctactcaccctggctgtgatccccatccatgaacaagatgcctggtgggcggtcttggaaggggctcccagtgctgagtttgaggaggaggaatccccagcgtgggaccctccagccagcatgcagttgttacaggtcaggactacaaacacgttgaggaggctgcccgggaccccgctcatgccgtcagcaggagctgtgagagtcgtggcatctgttcagtcaggtcactcttggtggaggatgtgggatggacccacaggtgccgcggaggctggcagctgtgctgagatgctaaggacctcagctccaggcaccagtcgtccaaacctgagcttcttgttgggacaggtcattcccctggctcacaccggctctgtggaaacgctgccctcagaggagagctgggggtgtaggcagcgggcgtctccccttccaccctccacagcccccatggcagtgtcagcctctcacaggggagggacagggacacggacctggcttgttgaccccacactgagccgtgacaccagccccctgggtggccagtcttgggggtctcctcaacccagcagaggggcctgagtcctcacagtctgagacagccacactgacaagagcccctgtgatctaaggactagagatttccaagcttttccaatgaacctgccttcttcggaacccatggggacaggcagcactgagccaagaccctgcccagggcaggggtcgcctactgacctatcttttattttctcagaatttctctgattggccacgggcctcatcacaaccatgccaggcggatggctttcccccctggtgtttcgttacgcaggcacaggcctgtgcgcctgactgagcccgccgtcccccatcagctctgacgggtcgctgtggtgcggctaaagggcttcagaaccattcaggtgagccctaggaccctcctaaccggccccaggtacccctcccgggtctgcaggaaacctctgcgccagctcttcaacgtgagacacagaagaaggagagaatcatttctttggctggaacatcatctcagaagaggctcttcaacctcttacggtcaatttaatgaaaatccattttaaaatgattcagtgatttgcaactgtaaaagtctgaagtcatttccacttgaaaacaattgcgatggtttagactttatttcaaaagcaaacggggaaaaagaattgcttgaaagtctcagacccactgtagttttaaacacgctactgtcggctcatccagtattcatggacaggactcagggaagtacgactagactggaaatgaacgcgggctccccggtagcctgaaaacacaggtgcagacatctttcctatgaaacccttgtgatgcttcctttcatttcaaagtaataaaagggtaaagctgctactaactact

SEQ ID NO: 68 - DNA, 2287 bp, Homo sapiens
tttgttgaactaaagtcagctgagccccgctagggagccaggagcgccaggcccagaaaagcagcagccgcagccgtagacatgtccaagatgttttctggtggtgcatcttcagcagggaggcgggaagggaacaggtgtgggcaggcagagctgaggaggggtgcaggaggccgcctccgggccccagatggcatctcaactgtgggaagagtccccctgccctggtcctgcccagcaggctggtgggccacctgaagcaactgtcaggctctggccgttgactcttcctgctggactgaactcatggccaagagttcgttttgggggagctccattttgtctcccccaaaatggcctcctttatttccaccctcaagctgctgggccccggctggcctcacgttggaggggcagaactgtagccacagtggcacctgccagatacctaagctggggctggataccaggtgaagctcttacacatcgtgtcaaggcatcttggcagccaccccagggccgctccttaggtagccctcgctttgcagatgaggaaacagtcacatgctcaagtcacaccgctaggaagcggtggagttatggttgggtccaggtctgtctagatcctgcgctctgccagtgcctgcaccccccttcccggccccgccgattggcatcttttcataaacttgaagggccccaagactctctgcttagctgagcagcccacagtcttcctgagaccccttcccaggtccaccaggcctcagggcctggaaacagatacttcctagcccacatggatctgctcctccaaaccagtgaggccaaagggagggagcagaacatttcatgagacactgctggagggtgagtaggaacaggacaggagcccaaggggatctcatcgccaggggcaagctaagcactgggcttgacagggacagcaaggctaccgcattgcaccattatagggagcatcatgcacactagctgtgcagtgcacaacctgtgttgctgtacagagcaactggagagggtggcagcaacaggaatgtaggagctgtaggcatgtccagtggtgagaccggcattcctcctcccagggacagtgagtgactgcaggccttggggccccaacactcaaaaacaaatgtcctgccaagtggagggcccggcagaggctcttcagcaattcccattttccccagtcctagccctgcctctcagagaaagggccaagctgccacctcccccttctccccagaccctgttccaggccccagctggcttcctggctggctgctagccctggctttcaccccaaagggagccactcgtaaacaggaaatgcttcccaatgcgatgcctgctctgggcgccatcgccagcccacaggccgagggcaatagccaagcagcagtgttagctgttcccaccaactgcggaagagggggatgctcaggggcttcccagctctggggcccgccatgacggaagagttgccaggcctgagacagacgcccacaggccgagcccaccagcctgtggctctgcctctgaccccactgccctccagcagtaacccccctgtgagctgatccctgacactgagcatttctgctccctcttcccagagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctc

SEQ ID NO: 69 - DNA, 2621 bp, Homo sapiens
aactttctgaggcataagcaggcacatgtcgcctgcaaagagggaaggggtgggtacttgtgaggagcccagcactgccttgcttggtctggacttacgcatttggaagagtagggagatcatttaagtctctaaggagaccaccaaatggaaagttgcccaggtctttctcaaatccaagagttcccaaacaaggagaatggtgtgctccatttcacaatgttggtaacttacgaaactggaattcacacctaaatatgtcaagctccagagcctagacatcttctgctgttcaatgtggctaaatggcaatgaaaaatcatcctgagcatgggatcctgtacaagtcatcctgtgcacgaccatcttcccagtgggcctcactctacatggcaccacagctaggtgccccagcctgtcatgggatagaggctgcactctgcctgatgcccatgtgtttccaaagcaaagggggactcaggcctctctcccttgacccctctggggcacatcagggaggggctggcagattgctgaggaccatgaagggcagggcggtgggctttactggccccagagcttgccccaggctgtcctgacatccactgctctctgcaggaaggccaagaagtcactggagtggctgggggggcagcacagggatgagtgtgtgtgtgtgtgtgtgtgtgtgtggcaaggtgttagtgtgcctgtgagggtatgcatgaggagactccacagaggtggcaggatgggtctgggagggaaaggatgggaggagacactgaggcagccagtctgctcagagaggcagcggtcctggccagggggctgtacatgtctctcgccccattctctaatgacctcaggacagtagccattgcatgtggggttcactggacaggaggaccccaccaccagcagcaaaatcataacacctgccttcatcccaccacattcttcttcattgacctccaagggctctacagctgcacgtgttggataaatgccagttccccagcttgtaacccaaggagtcatgagtcagagccacccgatcctcagctgtataagaggataatgctgaattcgagtcattgtgggaaattgactgaaacaaatgagcaacatctaacagtgctgaagagcatcatggcctttctcctcccttcctccctctggcactggtatcttcccatctggcctcctaaggctttgcccggtaaggctctctgcccttatccccatctctgaggtacaactcttctcacagtacggccccagagatgagtccaggccacctggctgacccttaccccctttccccgtatgcagacttcctcaaccagacccccaagctaaccacagtgggcccaccctctccccaacaccctcccttcactcctgcaactctcgcttggcactctgctactgcttttgccaattgttctcacctcgggtggacaggcctctctgtgtcaccctcctatgagcccatgaggagggtgggccaaaagtcaggcttaatctgcctgctcctccccagccagcaccactctacaaagttggaaggtccataagaagcagagcagctgcttctgaaagggcatccacctaaagaacgtgtgcgatggatcgccttgcaggtaacagggctgctcagaggcagatgcccctggaggtgtctcccacctgggggctgaccaccccgtggccctgttacagtgcacgtgcccaagcgccagctcctgcctaccttcctgatgccttctgaaggactggacacgcagttgtcagcccctccgttcttgctgatggtccgccagagttcagcaaacgtgctgtcctgctccagggggttggtgcccttggctcggaagtactcatatacagcagaatcccggacagtgccataagacatttccacttgtttggacaggtcctggaaagtcctgaaatgcagaaaggcagcgaggcatgagtacatgctgtgcattgcacactgcaaggatacaaatgggctgcaaggcccttctgaactccaagcccagcatggcccactatccacattcttcattccccatcccccaaagttcaagtccttcagcccagagtgggacttgcagcgcctcattcaattacaggtgtgttttctcagtgcagattaattcaataagatgactgggcacctaaaaccaggttctttactgaactggagggataaaaggatgagtaagacatgattcctgccttcaaggagtttatagtccagctatagaagcaaacatatagacagagaatcatagtatcaaagagtcagggcaacatgggaggctgtatgctgcggatctccaactcagacgcctgcagaggctgggcaggaaagaggcctatgttggcaagatgaacgataatgatggctggcctgtgacactcagagacagcatgaggaagaaacgcactcagagaccaactgactcagggtaaattaagaggcatcccctccaaagcttgcagctgtgctggggtctagccaagtattgacttcgaatgctcccctccccatgacctcctcaaccaatttggtctttgaaaaaataaaaaaattggatttttatatc

SEQ ID NO: 70 - DNA, 1830 bp, Homo sapiens
acagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggttttccccccccaccccgtcatgtacagctgaatcatgcagaatttgaagatcaagatgatgaagccagagttcagtatgagggttttcgacctgggatatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaacctgattttcggatagctgccacaggagttgtccttgatctggataaatccataaaaattgtgaagaaattaaagctaactggttttccatataaaatttttaagaacacttcatttattaagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcgatattgtcttcatgcaaacttggtatcctgtttccatcccagccttctataacccagtaacatctttgttgaaaccagtgggtgagaaagacacctggtcaggaacgcggaccacgggccaactcaggcttgcccatggtgtcagactaaaggcaaacaaggactctctgtataaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaacaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcaggg

SEQ ID NO: 71 - DNA, 2390 bp, Homo sapiens
aactcaaggcataaggcgatccagcacctaagatctcagcaaaaaaaagctaggtcctgaggcagctagtggaaaaacaagagaagggaagtcaaaaggctacttgctgtcagctaaagccagacaacctctcctgtttcatctcctggcaacagaatgcatcctccttgggaaactgcctctttccccactcctcagagtaaatcttgctgctgctcactctttgggtctgcactgcccataagagctgtagcactcaccgcgaaggtctgcagcttcactcttgaaaccagagagaccacgaacctaccgggagaaatgaacaaattccggacacaccatctttaagaactgtaacactcactgcgaggatctgcggcttcattctttaagtctgtgagaccaagaacccaccaattctggacacactaatatgctgttggaaactggctatatggaaaggctatgtggaagaaaacaaacaccccagccaacataatggagctcccagctgacagctgacatctagctgattgccaaccactttggaaactgatcttcaaaacccacttgagctatgtcaagagaagccacctgtgacacagaagcagaaggatccaagtcaaaggagtttatttgggaggaaataccacgagagaatgatcattcgtaactgaggcacacttgccttttgcaactaagctctactgaattccaaagctatagaaatatccatcttgacctggaaagtctgtttctttgctagtccagaagattttttttaacatgaacaagatcctctcaagcactgtttgctttggactcctaactttgttatccgtgttgatttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattgctatggaataaaagatgaaatgctcctgattattgtaaatacaaaattgcatgcgggattgtgtaaagacaatgccaggttggactgccagaatgagccaacagcacttgcttccccctatagagagcctatgaatggacgtgcagtcagggaggtttcatatcaccaagattcctatcccagaaaagcagatgttcatagctctgggaatggaatgcgcccctcgtggagagccaataaacagatgcatggaaggcgcctgtccatatggataagatagggttgtaaacgtcctcatcttgccacggctcttctaggcctctttagggttaaggcatatttccttctgagaatttctggtctaagcggttgtctagcttcatgtcctgtttccatggattgtttgtaaccagcttttgttacaattgttactgctgattaatatcttgctaatcataggttatggaaagattgtgtttctgttttaaggctctgttagaaattacacacacagtatattgtaaattatctctgtatactgtacttctacatacaaatgtactgtacttctacatacaaatgttatgttaaagaattacttcatccccatgtgaccatctcacctcataatcaaatgaccctaaatccctcattaacctacccctgcccttgctaaacttaataataaatgctggtatatccagtgcattgttggcaccatgggaccagaaggtggtgacccccctggacccagctttcactatcttgtgtgtgtctattatttctcaacctgctgatccgcctgggaacaaagagccccgttgcattgcaggctgctggccagatcccgcaatactctgctgtttaaaattgtagctgtttcaatcataaagaaactggcatttattatgcatatgattttttcaccttgttcttgttactaagtcaattgtgataagcttaaggtttatgttgtgaataatcactaatcagttgcacttttgaaggtatgtcactatcaaaatggttttgtagagctagagttgaaaatgctgtatctatcgtatgctttccataaattcattgcttatgtaaagttttgtcctgttgtgactatgctgttgaactattaattaaaacattttgaaaagc

SEQ ID NO: 72 - DNA, 2550 bp, Homo sapiens
agtttaattacgtccccgggaactgcgccgatttggacttttggcacttggacctatgctttaaaaagaaaaaagtgtcattggcgtggagtggggctagtggagggtgaggtgaatgcgccgtttggaaaccacaggacagtgaacgtttcgtctctcccagcgagactctcccgcgggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagtattacaaagacagggggcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggacccaaccctggaagaaaagatggaatattttcagaatcaacttttaattctccacagggtgtagccataatgaataatatcatatatgtggcagacactgaaaaccaccttataagaaagattgacctagaagctgagaaggtgagcactgtagctggtattggaattcaaggtacagataaagaaggtggagcaaaaggagaacaacaacccattagttccccttgggatgtagtttttggaacatcaggttcagaggtccaaagaggtgacattttatggatagccatggcagggactcatcagatatgggcactcctgctggactctggcaaactgccaaagaaaaatgagttaacaaaaggaacctgccttaggtttgctggaagtggaaatgaagagaatcgaaacaatgcctatcctcacaaggcaggttttgcccaaccttcaggcctttccttggcctctgaagatccctggagctgcttgtttgtagcagatagtgagagcagtacagtgagaaccgtttcactgaaagatggagcagtgaagcacctcgtaggaggagaaagagaccccatgaatttatttgcttttggtgatgttgatggagtaggaatcaatgcaaagcttcaacacccccttggagtaacatgggacaaaaaaaggaatttactttatgttgcagactcctacaatcacaagattaaagttgtggatccaaaaacaaaaaactgtacaacattagcaggaactggagacacaaataatgttaccagttccagttttacagagtcaacttttaatgaaccaggaggcttgtgtattggagagaatggagaattattatatgtagcagacaccaataatcatcaaattaaagtgatggatttagaaactaaaatggtatctgtgctccccatcttcagatctgaaaatgctgtggtagatggcccgttcctagtagaaaaacagaagacattacccaaactacctaaatctgctccaagcattaggctttcccccgtgactgcgtgtgctggccagactcttcagttcaaactcagattagacctcccatcgggatcaaagctaactgaaggagtatccagttgctggtttctaacagctgaaggcaatgaatggctacttcaaggacagatagcagctggagatatagagaacatttccagtcaaccaacaatttcactacaaattcctgatgattgcttatcacttgaagccattgtatctgtcagtgtgtttctttattactgtagtgcagacagcagtgcttgtatgatgaaggcaattttgttcagtcagcctttacaaataacggatacacagcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaataaagctatgctcctt

SEQ ID NO: 73 - DNA, 3352 bp, Homo sapiens
ctggtgcgggcacagaggttgctgggctgcttccgggcagtgctgagtgtggagctggaccctgtggaggggcggctgttggacaaggagagctccaagtggcggttgcggggccagcccaccgtcctcctcacactggcccacatcttccatcactttgcaccgcttctgcgcaaggtgtatctggtggaggctgtgctcatgagcttcttgctgggcatcgtggagaagggcacacccacacaggcacagtccgtggtgcaccaggtcctggacctcttgtggctcttcatggaggactacgaggtacaagattgcctcaagcagttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtctcctttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccat

SEQ ID NO: 74 - DNA, 2304 bp, Homo sapiens
atgactcgggattctactggtgtggaatctacaacgcttccgaaaacatcatcactgttcttagaaatatcagcctggtggtgtctccagccccaaccacgtctcctatgtggactcttccctggctcccaacaagcacagttctgatcacttctccagaggggacctctggccatccctccatcaatggctctgagaccaggaatggcagctaagagcaaaatgaagaacaagagaaaatacattcatggtcattgaaaaataacattctagactagcagtccccaacctttatggcaccagagactggcttcgcagaagacaatttttccatggacttggaggaaatcaagagcccctgcctgccttggctcaggtggccccagattcctggtcttggtgctatgtggactcctcctggccaagggcctgatgttgtgagtcctgttagtgctcctgatctgcaggtgccacaggacagcagtgacgaggtttctgattgtcccagcacagccttgtcccaggacccttgggtgcatgagccacaacatggatcctggatgaatcccagttcttcccctgcccagctattgggagctggcctaagtattgctccccacctccttgtgaggaaaggctagcgctaagcctattggagagaactttcagcccctgaactccccggtggtgacccctcacccctgcactgagcccccttagatctactgcccctgccctgactttcgccattgggaagacctggggtgggggtttctgcatccgggtcaatgcccagctcagcatcttcagctgtgcccaggctcctctccagcactctgtcgttctctgagccccacctcagcaggtctccaggatccctcacatttcccctgtttgttgcctgtggtctgccctagagtcctatgaatttcctcttgtgcttaattaaattcaacctctgaactgaaatgtgtcaggggcagctgagcaagacagcagttgtatcccctcaccttcctcccgtcccaccccagatatcctaaatgagagagaaatgacttaaaaataaatgataaaattgaaactaagaaaggctgtaatcagcagactggaagctgaggaagatctagaagtaaaagaaaaaattagatgcgttaaaatgacatgagcaggcgactcagtggcccaaaacaggacccagaacattcatccgtaaatggaatctgataatctggggcccaaattctgtttacttaacatgtgagaagattcacagcctaaaagagaaaatcaagctgaactaacaataaatgatggtgggtgaaagataaatgttttagggaacagaagaggagcacatatttatgaagcaagaataggtacagtcattttccaactaacatctagtgagactgggattcaccactcagaatgggggtccaccatgagcaacagatttgaggtaccagtgcatagcagctgaatgccagccctgtaaaagaccaccataaagagagctccatgttcttttgctcttttggggatgggacgtcaaacaaaagtctcttcgtgtatatctcagctcctgccacatgatcatcacctatctgtgagaggcatcgcttttgctttgtttatttatttttttaatcctcattccctatgtccacttgccttcctctccgaggcaactactctaatgcatttggtatgtaactttaaatttgaatgtattcttgtaaaacatccagtatttttttttctgtgactatgttttcacttacataaaagaaattgtgatagacctttttcatatgcttgtcttactccttgctgggcacatatacacagcccacttcttttcagtgcttattccattgcgtacatatcccacagtgcatcattccgaacccagggtgcatgtgcttttttgccttcacttttctatatcataaatgatgctgtgatgaataccctccttcacgttctcttgtggaatcatgtgagacttcctttaggacttatacacaggtggcatcagctgggttgtgggatctcagacatctaattaatactgccagcttgtgttgcctgaaccaagaatctagacactagcgattatgtgttttctctgagtctatgtgaagtacacagcacaacctatggaatggtattgccaattaaaaaaaaaatggaaggcaagaataaacgtagctgagtgatgctacatggggctagatatatgattatctctacttttgtgtatgcttggaaattttcataattaaaatggtacctaaaatt

SEQ ID NO: 75 - DNA, 2815 bp, Homo sapiens
cactgtgtactgagactggatgcatccttgcaataaaaaagaggttgatcacgacaaatgtgaaccccgccgttataaaaacagccatcatggctgtaaatgccaaaaagcagtcagtcttgtaacttgaaaaaaaaaaaaaggaattgtagattgtgcgcatggactcggagtgggggcggtggacagtaagtcatgatgttttggtggtaccacctggttgaatttcttcatctgaataagaagctcctgtgatgttctggggaggccttggaaggctagcgcatccctcatagaaagtgaatgggagctacggacaccgtaccctgggctcagagaagagcctgctggacctggaccttgctgagggccctggccccacctgctgccagggcctgtttctccctgcaggaagcccacagccccgggctcacccccaagcttgtgagaggctgctgcatttcccccaccctaacaggtcacctagaccccaggccacgtatgtgaacggcagcctcccaaccacacaacacatcaaacaggagtccttgcccgactaccaagccatggcagaggcccgcacatccctgtctgcccactgtcggggcccgctggccactggcctgcacccagacctggacctcccgggccgaagcctcgccacccctgcgccttcctgctaccttctgggcagcgaacccagctctggcctgggcctccagcccgagacccacctccccgagggcagcctgaagcggtgctgtgtcttgggcctaccccccacctccccagcctcctcctcaccctgtgcctcctccgacgtcacctccatcatccgctcctcccagacgtctctggtcacctgtgtaaatggactccggagcccccctctggcgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctgggaggcagggtggtggccgggcggcaggcgtgccgctgggtggactgctgtgcagcctatgagcagcaggaggagctggtgcggcacatcgagaagagccacaccgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccgtccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaaggagatgtg

SEQ ID NO: 76 - DNA, 2251 bp, Homo sapiens
tgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacaggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcagcagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccaatatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagc

SEQ ID NO: 77 - DNA, 2685 bp, Homo sapiens
acaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacaccccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcgaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggccagtccatccatgggccgccctcggagagaggcttgttctagatgtattggctgtctgttttttgatgtctctgtgtgccaaacagcctggaaatggggtacgcgtgtcccttgtttgggtttcccaatcccttccgcccaaggctttcctgggacacatggagcccagctctctggctgtcttaccatgagaagttggtaagttggctgtgagggggttggatccaggaagcagccctgggacagcccattctgctgttgatagcaggaaaccacctgctgggagacaatgggggtggggaaaagcccaggagagcagtgggtggggctgggcatccgtggagtggggctttgggagaccttgaacggccccaccctggaatctcctacaggaaggtgaggaggtggcaggttccacccttctctaccagccccgctcgctcgtgggagttaaccccctaggggagaagagtcttcactggggttcgacccatgggggcctggcatagtcatgcagaatggggcgggacaatgccaatgccttgggactcagacagggctgagtgcctccaccctgatttttgcctctgcactgcgcccccacagcccactcaatgccagcctccttctccaggcagagagccccatgtcaatgctggccaaagctctcaggaggattggaggtagaactggccctggtatgccaacaggggtgcctcttttagtgctctcccaataatgctcatcctgggggcatcaggacgcaggcaggtggcagagctgggggcagcttgatggcacaggcagccccaaagatgccaggaacagggactgtccgggtgtgggttcccagtgagatagggccctggaaggagtgcagcagttactgacaatatagtgccagggttggccataggagaatgagcccaagcgtaagtggaagtttccctttactttcagggattggtcaggggtggcagaaaacatgtgggttctttgtgtagatgtggctagttccaattagagaagtcctgcagctgatgttgccctcaccgtgatagcaggaggatgttgagaaatgggcttgggagacctggaggagaagttaccctcggcccggacgttgccttcctttcatcacagggcctttaactcctcctagggagtagcagagtggccctagggaaagtggccatcctgaaacctagtgttgctgtgacctggtgacagaaatggaaacctctgtggctcttctggtcatccttggtgggagtgggaatggtgtcacctttctagagggccatctggcaccatgtaatcacgccacagatctttacgaagctcctgctatgtaggaaacactatgcctggcactgggtatccattaaaatgtaaaatgcacgtgacctggcaattccacttctagaaatgagccttcagaagtgctcatacaaaagagctcaataagtatcatgcactaattcattgtgccaccagagctccctatgcagccttttaaaagaataaataggatctgtagcacc

SEQ ID NO: 78 - DNA, 2462 bp, Homo sapiens
gaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggtaactgcccatgctcaccctggcactgaccagccccaccccctccccagcagccagagaagcagtggcccggggcagttccgagggcagtgcctgcagtcaagtggccgggtcaggcgtggtgatctcttcttgcctcgtgatgtcagggttagggagctgccagtttcagaacaagctgtgctggacaggttacctcctgagtggagtcattaacttccccacgtctcaactgaaaggggcctgagtgatatagagaaagtggagaggggtttctcgttgtgatcattttacctttcttacagctaactccaccactaagtcaattaaaacaatccatcctt

SEQ ID NO: 79 - DNA, 2205 bp, Homo sapiens
agttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggggggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcatagg

SEQ ID NO: 80 - DNA, 2556 bp, Homo sapiens
tactttgcagggacgacgtcgaagcacctctcatgatcgagtgccccagtctgtccagatacggcaacgcagtgtgtcccaagaaagactggaagattctgtgctaatgaagtattgcccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagaaccaaagactcaaagcccacactctccgaaggaagagtcggaaaggaaacttctcagtaaagatgataccagtcccccaaaagacaaaggcacatggagaaaaggcattccaagtatcatgagaaaggcatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaggatcctctagatcgtctgaaaacattaaaaagactaattcacgatttgcctgaacatcattatgaaacacttaagttcctttcagctcatctgaagacagtggc

SEQ ID NO: 81 - DNA, 1890 bp, Homo sapiens
aaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacaggtgggtataatgtagacttccgaataagaatattttatcgttttcataatattaaaagtattcctgaagt

SEQ ID NO: 82 - DNA, 2683 bp, Homo sapiens
actccgccgcgccctgcgggctttcttttccaggcccctgctcctgggtcctgcctccgaggtcaggcagggcctgtggttcctcccgacatgtcgcagaagccccagggactgttccgcagctctagatggcccagtggggaggggctgccctgtgggcattgctgtctgatggcctgaaggcaccgcttggagggacacatgcctggggacagtgggctcacagatgtcttgctgctttgccaccgagcctcacagccatctgctgacctctcagagcccagcaggcccctgcccgggggttcgtggaatgcccctgggggtctcagacccactgctcagctcttggccaggctccgtatctctctagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggtaagtgcagttgccctgtgatggcaggtggaacccggctgtgcacacagctaggccttattgttccccatgctgttccctgcactgttccccatgctgttccctgcactgttctctgtgctgttccctgcactgttccccatgctgttccctgaactattccctgtgctgttccccatgttgttccctgcactgctccctgcactgttccacatgctgtttcctgcactattccccatgctgttccctgcacttttctctgcgccattccccatgcgttccctgcactgttccctgcactgttccccatgctgttccctgcgctgttccccatgctgttccctgcactgttccccatgctgttccctgcgctgttccccatgctgttccctgcgctgttccccatgctgttccctgcactgttccccatgctgttccctgcaatgctccctgcactgttccccgcactgctccctgcactgttccccatgctgtttcctgcactattccccatgctgttccctgcacttttctctgtgccgttccccatgcattccctgcactgttccctgcactgttccccatgctgttccctgcaatgctccctgcactgttccccgcactgctccctgcactattccccatgctgttccctgcacttttctctgtgccgttccccatgcattccctgcactgttccctgcactgttccccatgctgttccctgcactgttccccatgctgtttcctgcaccgttccccatgctgttccctgcagggttccctgcactgttccccatgctgtttcctgcaccgttccccatgctgttccctgcagggttccctgcactgttccccatgctgttccctgcacatttcatgccccagaccttcccattctcccaccaacacactggatcatccttcaaaagcttctgtagtgtctccaaccactcaagtgctgggactgggttggggcaggatggagttagaccctgcagaccctggccttcgaggtccgtccccctcagacgtctcccccaacgccatggccggctcttgaaggccacagagagatccacgtgctggacaccgactacgagggctacgccatcctgcgggtgtccctgatgtggcggggcaggaactttcgcgtcctcaagtactttagtaagcttggccctggggggctctgcccagctgctgctctcccagggactgcccgcccagcccccctgtgccccacagctcggagccttgaggacaaggaccggctggggttctggaagtttcgggagctgacagcagacactggtctctacctggcggcccggcctgggcggtgtgccgagctcctgaaggaggtgagcttgacccccgaccctggcctgtgctgaagttcccgggcccctggcccagtccctggccctgtcaggagcccccgtggctccgcctcccggccctgggctgggccttctcaccccttcctgtgaacaggacaccaaacaccactggtgggcagctccagagatgagtctgtctcctggtttggaaagagctggaacctccagggtggtgaccctaggctgccaggcagggaccctgggaggctggggtcacggggtgcagagctgggtggggcaggggagcagaaatggcgccttttcttcggtgttccgtgcaggactgccggctgcttctgcccccgaaggtcccgtcggcggcggggcacagatcctgcgggcgctgcctcagggctcccatgttgggcactgcgagaacccagtgtctccctcacctcgctttgtcttggccctagaggctgggcctgttaccccattttgcagattgagaaggcgctcagggagctgggtgctttgcgcaaaaccaggcagcgaggacagaagtcccgccgtgtggccctcatcgaagccccgtggggcctccagagaccacacgggcctgagcccctgcacttctgtgtcgcaggagctgatttaatggagttcctgcctcagaccacaaggttcggagcgcccgcccacccctgcccctcctgggcaccctgcccaccaggtcacctgcacctgctctgaataaactgtgaagtc

SEQ ID NO: 83 - DNA, 3138 bp, Homo sapiens
gcatgtgccagtggcggggcacaaggcgccagcggcgagcactggcttgcttcacagtgaacgccttcgttgcctggcgactagtccctgcggcttagcggagagggggcgtcggcgttgggcgctcgcctgtcttctctggggggatcctcgggatactcccacgatctaggacagggcaggggcgagccagcctgaggaaacgtcaagggaaggcccagggatacaccgcgaaatccctaagaatccaaaaggatccgcaggaggcgtcaggcctgcctagacggagtgggaaatctttagagatggatcattttccttacaagaatagataccagtcacagagagaggacagcagcgtacatggtgaggtgctgacgattctggtccactggatcccaccatccctaggacagtaaataccgtcctagtcactacccagcaagttaccaccgcatcatttcctgcatgttccaaaatgaataaagacggaatcttgctctgtcgcccagactggagtgcagtggcgcaatctcagctcacttcaagctctgcctcccagtttcacgccgttctcctgcctcagcctcccgagtagctgggactacaggcgcccgccaccacacccagctaattttttgtatttttagtagagacggggtttcactgtgctggccagcatggtctcgatctcctgagctcgtgatccacccgcctcggcctcccaaagtgctgggattacaggcatgagccaccgtgcccagccaaaaagctgatgtgttttaagcaaaataagcatacgcatcaatagtaaaatgcttctggtaaaataaaggttcattttgttgatttcttttttttttttttttttctgagacggagtcttgctctgtcgcccagtctggagtgcagtggcacggtctccgctcactgcaagctctgcctcctgggttcacgccagtctcccgtctcagtctcccgtctcagcctcccgagtagctgggattacaggcacctgccaccacgcccggctaattttttgtattttttagtagagacagggtttcaccgtgttggccaggatggtctcgatctcctgacctcgtaatcctcccgcctcggcctcccaaagtgctggtattacaggcgtgagccaccgcgcccggcctcattttgctgatttctcttgagctcaggccagaaaaactgggaaaatcacaggctcttccacttactggatgtttgacaaaatattcttcttgggccaaaaacattggcattactgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtgtgacaaatgtgacaaaacatttaattaattctcataccttattgcacaggaaagcatttatacttgagaaaaattgtataaagaatggaaaagtcattaatatctgctcatatcttaacatcagcgagttggtatttaataaaagcattatcaatg

SEQ ID NO: 84 - DNA, 2087 bp, Homo sapiens
aagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatacgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttg

SEQ ID NO: 85 - DNA, 1940 bp, Homo sapiens
cattctccacatcctcttttgttctagtgcatggcatgggaagccctctctaggaggatgctgtggccacacaagcgctggacgaaccgctggagtaggtgacttccaaggtgtcctgatgtagtagctattagacaagctcctgcatttggccagtaattagcatgctgctgcacattgccactaggtggtgctgctgctccattcccaagtaacccacatgcatccctggctggggtcagccttggggtttcccaagtgtagaggaatccatctctgtgcctgtggtaatggctggacaccaggagagacccagaaaacagggatatcctagaagagaaaggcaaaataagcactcagagcagaggacatttgagtgtcaataatgaaggtggcagcagtaatcatggctatcatttactaaaaatagtggatattggccagacatggtggctcacgcctgtaatcccagcattttgggagaccaaggtgggtggatcgcttgaggtcagcagttcgagaccggcccggccaacatggtgaaactatctactggaaatacaaagattggccgggtgtggtggtgcacgcctgtggtcccagctgctcgggaggctgaggagggagaatcgcttgaacctgggaggtggaggctgtagtgagctgggatcgcatcactgcactccagcctggacaacagagcaagactgtctcaaaaaaaaagtagatactgtgctagtcacttgatacacatcatctctgatctttgcactgagcgaggcatgtgtattatgtctgcattacaaaaggggaaaaattaaggttcaagaagataaagtcaccaggcatggtggcgcatgcctgtgatcgcagcactttgagaggctgagacaggcggattggttgaatccaggagttcaagaccagcctgggcaacatagtgagacctcatctctacaaaaaaaataaaattagctgggtgtggtggtgtgtgcctgtagtcacagctcctcgggaggctgatgtggaaggatcacttgagcccgggagatagaggctgcagtgagatgagactgagccattgcactcagcctaggcaacagagtgagaccctgtctcaaaacaaaacagaaataacaaaaaataaggtgacttgctggaggccacatggctgtgagccaaatacaggtctgggttatcagggctcacatacttctaagtacaccctactgccttggaatctgctgaagaccaagcccctgcccccaagccatggcaaagaaggagggaaggaagcaaaggtgcccagcggggacaactcggggaggggcgaggtgcccagggcccaggaaggccaagcagcatgtggcagggcagcatcaggtgactcccaagaaggaatgaggagaggatgtgaggaaagagccacagcacagaggcctgctgttaggtcagcggagaccacggcccatgggacctggatctacccttgatgctaacaatgttctttggggaaaaaatctataatcacaaagtttctgcaactggactgtagtcatggttgcagaactgtatagatttactaggaaccatcaaattgttcacttacaatgggtaaattgtacagtacataggttatccctcagtaaagctgtatgaaatttatagtcatgaaactaatagtgacaaacgagctgggtaagtaggtctcagctgttctgtaggcactttgagaagaggaagagtagcatctcggttttaataaaagaaagcctggcccatggcgtccagcttctgcttgaatactttcagtgcccgggagctcagtatctcaaagcagcccactcctgtttaagagaactctaaaccttagaatgttgaaatacatcattattattctagtactgctgtgaaaaataaatgtctttgttttgccacat

SEQ ID NO: 86 - DNA, 1919 bp, Homo sapiens
aagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttggtgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaagaattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 87 - DNA, 2153 bp, Homo sapiens
ttgttgagtttccttaagatcattattttgaatttggcaattaattgatttcttttttattggggtctgtagctagagagttattatgtacctttggcggtgtcatatttccttgctttttcatgtttcttgtgctcctgcactgatgtttgtgcatctgttaggacaatagccacttccaaactttgtagagtgactcatagagaaagactttcacttgcatttgggttttagtgggcttgctggagagggtgtggtgactctgcttccagatagatgcagtgatatagttttctttgttgaatgaagtcttcttcagcttcattcaatgccagcagtaactatggacacttcagtgacctaggctgtagaagtttgtggcagcagtgtaggatgttaatgtcctcagtgtcaagggcttttgaggtcctcctattctcattttttccccacagtggggggacctgtctgaggggttctcctttgccatcaggtctgacacagcctacaagcagctacagtggtgctgattccaactgcaggtgctcagagtggccatggggctgggatcctaggctcagcatctgtgaacctactgcagcacctgtgccttgtggtatgtggcagggtttggtgtaggttgcccacagagccaatatctgtgactctgtggcaacccctagctgcttgggcccaggggctggtttatagctgtgattctacccctggggacaaagcatagcactggcctgactcctgggaagaagggctgctttgcagatttgagcctgaggagcagaatatggctgcaattcaggaacctgggccaatagagctcattggcaactcaggtcccaaaggatgaggcatcgtgtagtggtgactctagaccctgggatggtggggcttagcagtatcctagattctgtgaccccagaatgccagagcacagctgtcatttgggccttggggtggtgggggacaggaaacaaaacagcagtgactccactccccagggagaggggtgtctcagcagctcaaactctagggggctagtccagctccagggaagtacttgagtattatggcctgtggggggtgcgagtgtctcagttcagccactgctctgtttctctgggacccggggtactacataagctcagccctgggatgtacaactgctcagcttagccagggcactgattgcccaggggatggtatgctagttcagctcaggcctgggggatatgactattctgggaggaccaggcaccatttcctgggatgcagggtgctgcttcaacttaggcaccaggaaggtgtgattgctctgaatggccaagatactgtttttccaggagagagggtagtgcttcagctctggcctggggtagggaggggtaggtagagtagctccacccttgatcccatgggaaagagtataacagctgtttgcagctcagcttgtggatgttgggctactagactggggtagttcagtgatgacttagcttcagggatgaagaggagttgtggctactcacccgccgagtaagacactctagctgtagttgcaattccaagatggtgtagcacagtagctacacaggccacagggggcgaggcacagtgtcagcgtctcctctggagggagcataggtatgtggactggaggcagctccctcagctgggcttagtccttgtaaagactgcagggcaccctactgatgaggtctgtatgtgttcgaggtgttggtgggggttgctgggatcctcttgcttaccttcttgctgtaggaagaagttcctcctggttcccagatgatcctggtttggggatggggtaaggcccagcatttcttcctttctttatttgactattccaagtttctgtgctcaccagggtttctgttacttctctgatgcactccagtgctctccctgttttttgtttgtttgattgttttgtttcattaaaatgttgctattctggctttctttgtgaaggggacaagtgctaggaacttccagttggccatcctgctgatgtcaccatgtattttgcacttgatcttagccaaaaggccgagaagcaatcgtcaccacttattttgaaacaattatagagtcaccggaagttgtgaagaaatact

SEQ ID NO: 88 - DNA, 1790 bp, Homo sapiens
atagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcacgtttccctcaatgtgcgcccgattggacaccatcgtttctaaatacctgcagcgaacgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacagattcgcggtgggtggggagctgccaggctccttttctgatctcccagcaggctttgactgacgctgtttagtctttctgtacattaaccctgccagataccgagaggttacaaagcctccaaggcctgtacaactgtggcctctccagagaagtggttcccagccttgactgcacactgtaatcacctggggactttaaaaagtactgaggcctggggcccacccacaaatgctgatttaactcctccagggtggggtctgggcagtggggaggcaggagtcacccaggtgattccaatgataggtgtaggttgagaagcgccaccttccagcttcctaactggctctgggaggggagctgggtgggaagttcaggaggtgggaactttgtacacgcagagcacctggaacacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggatttttttttggggggggggccttaattttaaaaatattgcattaaacttatttatcttgcttattg

SEQ ID NO: 89 - DNA, 2101 bp, Homo sapiens
agtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtgtcatcaccaatccgtcgccagaaggggaggaaactggaatccagcagcggcgagcagcagctggacggtaacatctggaaatggaaagccgacctccccctcctcctccacctcctcctcctcctcctcctcctcctcctcctctcacccaggatcacttccaaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggctctgattgtactttctccacaagcttcagcatggcagtatctctcaccacttgttttggtccaagggcagaaatgagcatcctggaaaccaatcagtacttccgctctgaactggaaaagtgcaaacagaacttccaagacctcacagagaaattcctgacatccaaagctactgcctactccctggccaatcacctgcagaaatatagatacacgatcccttaattcaggctcaggctgaagaactgacccacttacgacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacagaaaatcacaatggtaagaaaaatgaagacaggcaaaagccactggctcccaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggccccttggctgtggaaatagccaaagatgagatccagagccagtggcagcacctgaaggagacccttttcatcaacaactgcctgtgagaaaagctagaacgtcatcacagcagctttgatgaagaaaatggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtctcttctcttgccacactccactgtagaaataaaagaggacggggaggccagagctgctcaaaaccttataacccacaattctcatagttactctcaacttagagagggctgctttctagacacaccccctccaggcccccagactgccaggctccaggaataagtagctctaagaaatacagtatttcagtgtgagccacaccccactattgcaaattggagaggagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctaagtgacagagcaaaactgtctcaaaaaaaaaaaaaagaaag

SEQ ID NO: 90 - DNA, 2918 bp, Homo sapiens
cattcctctgggtagcaccatatgcaggctttgcgaataaagtgatcatgggctttcttgattccatttggccaatgcaagaacttcattggctcccctctaaaaaaaattccatggattgctgggatttttattttttattttttgaaaaaaatggtacctatccgtattcagcttggtggcttcacagtccctcccctgaacatccgtatattccttattctctcatttatggtgcagaacactggggtactaacctctaggaaactgttctagctgccagggaaagctaagagccctcctttaacaggaaagcagcagcatgctttttcttctctctgccgtttcagggaagagcaccttaaggccagtgttatttcatgggattctgtcctagagctgagaaagtaatggactcatccataatctcttttatagatttgaaagtgtaaacaatacacacttccttttttggaactccaattctaatatgtttctttttcattggaaattgaaaaaccaggctggttttgagattagtactagcagtgagtaaacctcctgtctgtggacttaaatccttttgaggaacatttcgttttagatttttacaagttttctaatctggcacgactttcaaactagcttaatctgttcttacagaaacctgtgtaaggacagactgcccacatacgggctccccaaacaaaacggcatttttatttcttgtccctgctcgggtttcaccgaaccttggtagccataatcagaacaaatgaaacacagtcaagttgttgtgttctgtttgtttttacctgccagccagctgatgctgacatttatacaccaagatgatccaaggttttggtgacgccggtggggactgccgctatatgtgcagggtgcccgggggtcatagtaatgttaatggagtaccagaatctctaacagtgtggtcctgtgtagccacattgctacacttacagagatgctttggggcctttttggattaagacagttctaaaagaccaggcctcacctatgatctgtgtataaagaattagcatcgcactgtagatctgcaagagaaggccgcctcctgcagtgctctctcttggtgaatgctaactctgctcgagggccttttggggaaaggacagtgcaaaacccttagagaggtaagtttcccacccttccaacctctctccacctgcagcttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcaggtaaggtaatgtttattcactgggaatgctttccacagccagacagctatgctaacagtctcaagttttcttccagtttgtttagatttaaatgatacatttgtaactttttaaaaactaaattttggttggatttttcatgaaaacctcttttttctttatcccctaaaaaatggtttgaaatgtcattgttatttaaaaacccgatgtgttggaacttctttaatctgctgtttcctctttttccccccctttgaaagtttcgcatagtgtaaacattcactatgtcttttaccttccctgctcctcccatctgggaggcgctgatgctattacccagtgctgaaaaatggcactctaaaggtatgggaaggaaggagcccaaggcaaccacctgctgtcctttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttctggaattcagcgtagctacctccagaccgtggtgtctggcctccatttttgtctgtcattcagctctgacttacagctgcaatcacctttgctataaggcacctgggtagaagggtggatgggcttcacatcaatttttttcttcctttagggtgggggattggtttggctttcttttgttgtggctttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccgttttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccc

SEQ ID NO: 91 - DNA, 2267 bp, Homo sapiens
agtgcgtctttcctgcgtcgttccggcgcggcgggagcagagatctgcggccgtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccaagcgaagaaagcgtgatgaggaccggcatgacatcaacaagatgaagggttatactctgctgtcggagggcattgatgagatggtgggcatcatctacaagcccaaaactaaagagactcgggagacctatgaggtgctactcagcttcatccaggctgctcttggggaccagccacgtgatatcctttgtggggcagctgatgaagttctagctgttctaaagaatgaaaagctgcgggacaaggaaaggcgaaaggagattgacctgctgctgggtcaaacagatgataccagataccatgtgctagtgaacctgggcaaaaagatcacagactatggtggagataaggaaatccaaaatatggatgacaacattgatgagacatacggtgtgaatgtgcagtttgagtctgatgaggaggaaggtgatgaagacgtatacggggaggttcgagaagaggcatctgatgatgacatggaaggggacgaggctgtcgtgcgctgcaccctctcggctaatctcgtagcctcaggtgaactgatgagttccaagaagaaggatttgcaccctcgggatattgatgcattttggctgcagcggcagctcagtcgtttctatgatgatgccatcgtgtcgcagaagaaggcagatgaagtattggagattttgaagacggccagtgatgatcgggaatgtgaaaatcagctggttctgctgcttggtttcaacacctttgatttcattaaagtgttgcggcagcacaggatgatgattttatactgtaccttgctggccagtgcacaaagtgaagctgaaaaggaaaggattatgggaaagatggaagctgacccagagctatccaagttcctctaccagcttcatgaaaccgagaaggaggatctgatccgagaggaaaggtcccggagagagcgagtgcgtcagtctcgaatggacacagatctggaaaccatggatctcgaccagggtggagaggcactggctccacggcaggttctggacttggaggacctggtttttacccaagggagccactttatggccaataaacgctgtcagcttcctgatggatccttccgtcgccagcgtaagggctatgaagaggtgcatgtgcctgctctgaagcccaagccctttggctcagaagaacaactgcttccagtggaaaagctgccaaagtatgcccaggctgggtttgagggcttcaaaacactgaatcggatccagagtaagctctaccgtgctgcccttgagacggatgagaatctgctgctgtgtgctcctactggtgctgggaagaccaacgtggccctgatgtgcatgctccgagagattgggaaacacataaacatggacggcaccatcaatgtggatgacttcaagattatctacattgcccccatgcgctccttggtgcaggagatggtgggcagctttggaaagcgcctggccaagtccaatagcctcatctccatcaagaggctgaccttgcagcagaaggccaaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaacc

SEQ ID NO: 92 - DNA, 2147 bp, Homo sapiens
atagtcgcttgttctccgcccgcggtggaccagctgcgtaacggttcacacactgatggcgcctggaggtttggcgaaatactgacaggatgcgacgtcaacgggagcgcagggccaagataccctttatatcaaaccgtctatcctggagcagaaaaatcctgtcttcattgctatagctacagattcagaaatgagcatgtaacaaattcaggccaaagagaggcaatggaaatcagagaaacactgttcctgaaagcttctgtcactcaagaatccatgaaacattcatgaacttcacatcagattttaatgcaacttgttacacaagatgaacccaaacatatttgactttttattttcagaaaagcttaatacatagttttgaatatgaaataaaatccagtgagattcaacaaattgtcaagttacacacttctgaatgacagatttgggaccagaagctagacctcaggttgtctttgcaaatgacacaatcctgtatctagaaaactccattgtatcagcccaaaagcttcttaagcaacttcagcaaagtctcaggatacaaaatcaatgtggaaaatcgcaggcattgctgtacaccaacaacagacaagcagagagccaaatcatgaatgaactcccattcacaattactgcaaagagagtaagatacctagaaatacagctagcaagggaagtgaaggacctcttcaaggagaactacaaactactgcttaggaaaatcagagaggacacaaacaaatggaaaaaaattccatgctcatggataggaagaatcaatatcataaaaatggccatactgaccaaagtaatttatagattcaatgttattcccataaaattactgatgcttagcacttttgagtgactagaccaactagcttcattaaacatgatgttttttgaaaacatattaagtgtgagcattactagcaacatagtggtagaaaagaaaattgaaccaatgaatggctaatactgacatattcagtagtaacaataaaacaataaaagtgactctattttagccctttgttttgcagtggaaaacactgaagttgtggcatatgaaaaaggtgcttttcaattgcgacaaaagcaaaaattgacaaatgggatctaattgaactgaatagcttctgcacagcaaaagaaactatcaactgagtaaacagacaacttacagaatgggagataatttttgcaaactatatgtgtgacaaggctctaatatccagcagctatagggaacttaaacaaatttacaagagaaaagcagcccctaaaaatgtgggcaaaggacatgaacagatacttttcaaaatagacatacatgtggccaaaaatcatatgaaagggagctcaatatcactgatcattggagaaatgtaaattaaaactgcaatgagacatcatctcacaccagtcagaatggctattattaaagagttaagaaataataggtgctggcaagttgttgagaaagaggaatgcttattcatcattggtgggagtgtaaattagtttagtcattgtggaagacagtgtggcaattcctcagagacctaaagacagaaataccatttgacccggcagtcttattactgggtatatacctaagggaatacaatcattctattatagagacacatgccacatgtatgttccttgcagcactgtacacagtggcaaggttatggagtcgacctagatgtccatcaatgacggactggatagggaaaatgtggtacatatacaccatggaatactatgcagccattaagaacaagattatgtcctgtgccaagatatggatggagctgggggacattaatcttagaaaactgacgcagaaaaggaaaaccaaatactgcatgttctcataagtgggagctaaatcatgagaacacatggacacatagaggggagtaacacacactaggtccttttggagggtggaagttaggagcagggagagggtcgggaaaaataactaatgggtactggcttaatacctcagtgattaaataatctgtacaacaaaaccccgtgacacgagttaacctatgtaacaaacctgcatttgtacccctaaacttaaaataaaagttaaaaaaggt

SEQ ID NO: 93 - DNA, 2867 bp, Homo sapiens
caactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacgtcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaaggtgcaagacgggaaggaggtgggggagctgaatctggagggagctgtgcgtggcgggggttcctgtctgttgagggagggtgtttgggtctgaataggggttcagaatgtctgagtgatgggaatcatgtggctctgactgtgtgaaggtgtgccccacactcactcaggctgtgtacttgtgtaaacaatgagaagcctggcccccaccctcgtgatgagcatactgacctgttcacggtatcagagcgcctcctgtgcctgtgtctgaatacatctgtgcgtacctctggctccagaggtgaacgtgtgccttccagggccagaggtttccaatactaacagctcctacttactgagcaattactctgtaccaggcaaggcacacaaacttgtatatgcatgtttcacttacctcacaacagttaatcctcacaacagtcctttggggtagtacacaccattggacccattttacagatgaggaaactgaggcccactgaggtcaagtaaattgttccaagtcttagtgaatgtgaaccctggcaggctgagctaacccccaccccaccccacgccacctcatgtctgtgcggtgagtttgtctgtgtgcactgaggccagtgcccaccctcaggccctccaaagaggtgggcagagtaacagtgccgacctgcctgccacttcctgcccctgccagagctgaccagagccctggcctgtctcctctttctcccctgttgcagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgacctgccagcaccttctttactgcaaagacaggggacttgcctgaatggcatccgccaacccagggacctcggcgcaacataggccttgtccttgctgcactcgtggtgtgcttctgactttaccctgtcccctaagtcaaggccgaactccagcctggtggctttgccagaagggagccagaagtgggtcagactctgggactcctgagatgggagaggcagggatcagaggacaaacaggtgggaatttgcgagctctgtgactgtcccacgtccaggagacaaggaaggtagggcacctgctgcacacgattctgtccagagtgagcactggatggtggagaccataggtcaccccagattccctgacctatttctgggacaccatatttccctcctcagtgtgcaccctttgaagggacccagcacagggtcttgggcctgggcagtctgaagactgataacttccccactccaccctacaagcagtgggactcctgagaacacggttctctcctagcctcagcccccagctgggtctcagaggagctgggggagcggtggccagcccattttctggggtgaggcttgacttggagaaaggcagaagagacgtcccgcttctgtgatttggtgcccccatatcagacaatgaatttggaagtggagaggggccttcatttcttatctacttggcatgaaagggtgccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagc

SEQ ID NO: 94 - DNA, 1898 bp, Homo sapiens
atattatctgacctaataagcctggatattttgttagaactggagagcttgggactcctcctttttagcaaaactctgggttagtggtgacagagaaggttggaacacattttaataaccattttttagtgattccttctcatccataaatttccagcagagtatgagttctagagtcaaatgcgaaaggttctagggcagcactgttcaatagaactccctgtgatgatggaagtgttctgtttggcactttccaatgtggtatccactagccacatgtggcttctgggtacttaaatgtgactgactagtgtccctgaggtactgaatttctaattttgtttaattttaatcaagttcaaataaccacatgtggctagtggccactatattagaagtgcagtaggggtgagatattttgtttcatatggtcttgttggtctgactgagcaaacaaccttgacgttgattttccagtatttaaaagcattagggaatgaagggaccctgattgtcatggcctgtctctggtaaaatatcagtggatttagaactgctatgttaatcagatcaaggggcttttgccctgatgttatgtatttctctcactgttccatgagtgtccctgtgggcatatcacagtatctagcattttctctgtctgcttgaagactgaaaatgtctaattccagttcaatgtttctccttggaaactaaccttctcttctggctgccacactttttagaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgtcgcacattttaaagttttctttttgggttgctctgtgtcaagagaggttacatggtgttaaatcggtacctgataatgtacccaaatactatggccagataataaattgtgctgcaaac

SEQ ID NO: 95 - DNA, 2419 bp, Homo sapiens
cttggagcacctgctgaggtgctctctgctgggggccgtaagtgagcatcgaaaaagctgtaaaaagtatccctgctgctctccagggactcacagcatggacggcacctgcattgagagaagacggcaatggtatcgtgatgatctacctctttgctttaaaaaggaagaaaatcctccatccaacaacgtagatggccctggaggatgttatgccaagtgcaagaagaaacgagaaggacaaatgctacatgatctcattcctatgggccctgcaacagccacatccttcttgactgaagacattggccttgccttctatcaggtttcccctctcctggggttcctctgcctgctctctcaagacacatggaacatgtacacgtgcccaagatggatcggccgctcagccgagcctcccagtgctgcctgccaggctggagggacccgtcttctagggacattgcactcccctgctcttctgagctgacccagtcttgaaccccccctttttttctggctcatgtggtgctgcctggtgtcagagcctggccttctcatatctgccttgtccctgcacagcctgaacgcaggcccccagaatagtcctggctcagggcctggaaaaaaaatcacctagtcagaacaccaaattacaactcagaaggttgcttagtgagcataaaattggagcaaagagaagtggatattctgaagggatgcttccgatgtgctgtggtagcaagatgcattgttcttttcgactctggggctatttccagaaaaagacctgggaggggacctctaaaattgggacatccatcctcccagacagtgctgaagggcatgaatgcactcctccctctccttcctttgtttaaaatattcctatcattctccaaaggcctccgcaattacagcattatgcattacaggtttcaagattgcatttaatcttttattagttccatctgcatcacttgcttcctgatgagattttgaggagttgccttaatctcatcagccctgtatttacagatcttatcctcataggattgcctctgggaagatttttgctgatgggcaaatctaaccattagagtcaaggcctggatttcatgccactaatcatgtccatagcctgtatgcggacagatcacctgcccccctcgggttcccagggcctcctgctcccaagctcctctgcctatttgcccacaggctttgcttctctcccaatgcaagtgtggcttcctcagaggcaggtctctgagtctcctggccaggaaagaccctctgatatgaacctgtagcactgcacacctcccttcatagtgcccagccgtcgttattcttcccacctttagggtttgagtagatgactgtgtgtattcatttcctagggctactgtgacaaaacatagattaggtgggtcctacagttctggaggccagaagtccaagatgaaggtgccctcaggggaggatctgtcccatctctctccctaaggctcccttaagactctagggaggatctgtcctgtgcctctctctgttgcccaggctggagtgcaatggcatgatctcgactcactgcagcctccgcctcctgggttcaagtgattctcctgccttagcctcctgagtagctgtgactacaggcgcccaacaccacgcctggctaatttttgtatttttagtagaggtggggtttcaccaggttggccaggcttgtctcaaactcctgacctcaaatcatctgcctgcctcggcctcccaaagtgctaggattacaggcatcagccaccacgcctggccctctcccagtttctgttggccacagaggtcccttggcttgtttccacactgtgcactctaatcctccatcttcacatggccgtcttctctctgcattgtcacatcatcttctctctgtgtatgatggtgcccacgtttccccttgttttaaggacaccagacatattggttagggcccaaaccctgaggccattaggcctgattttaccttgattatctctgttgggaccttctttccaaataagatcacattctgaagtccttggagtcaagacttcaacactccatggcatcctaacgaagtcattgactttctttgttgttactttcagcatatcccctgtctggcacaaagggagcacagttgacctgtgaacagtgcagaggttagggactcagacctaccttgcagtagaaaatttgagtataacttttgattcccccaaaacttaagtaccgatagcctctgttgaccaggaaccttactgataatttaaacagaagataacacatattctgtatactatatgtgttatacgctgtatttttacaataaggcaagctaaagaaaataaattgctaataaaaaatcgtaagaaag

SEQ ID NO: 96 - DNA, 3277 bp, Homo sapiens
ctcctggcaccggcgaggaggctggggaggggggacgggaattcccccaggggccaggccttgactgccctgcagggccctcgctgtcgcttttttccctcacagtgtctcatccctcaacctctgttttccatccaaaggcatctctgtgaatccacctggcgcgggagcggcgctgatgccacaaatgcgggccagactgctgggcagagctcaccagtcaacagggctgggtgtggctggggcagccctgagaccccaggccctgccgctgtggctcccccttcctggcccctcttctctgtgggacagaaagtctctcctggggaaggctcggagctgagctggtgggtgtttgaagtttctccacacacagggtcccctggcatctccctctgtcatttggtggccaagtgacatttcccagcagccctactgcagacgccatatgttctcggggtgactcaggtggcctgggcccttctggtagccgcttatccagcctgaccccaggctccagcgaggctgctccggatcggggctgctctgcccaggtgaagggcgggtgtgggaggtttccgtagaggccgctctcccctgctaccacggccccgtgtgggaccctgggtctgtctgacagacagaggcttcctgagccaggcccttgggatgacgggtaggaatctagggtggatccacaggaattagagattttttcagttttgttttccaaatgaagtcaacagccccctagcagcgtgatgctgatggtcctgtcccctatggcccccatcctggaggcaccctggtgtgggctgtgggcctgggggtccttggcactgtccagtatgcggacgtggcagcagcccacatttcccccagtgaccaccaggctgtgccctggacgtggccgcctgagcacggcatgtcctggggccccgtctggtggtcaggctcagtacgagcccatcaggggtactctgcccgcctgggaagacagtgtggcttctgggggctcctccagggaggctctggaccaggctgcagaggatgccaacctgccacaggctggcctggccgctcatggacatggcggctcctggcccagggtctctcccccgggaacccaggcgtgctcgcggccctctggaatgcaggcgctggggctgtggggggccgcctggcgcctggcatcttgttataaaaagctctggcgcaggctgctctcagtggctgcaggatggttgtggctttggaagggcagcccccaggggccttggtcagccacctgtgggccccactgccgagccgtggtcagccctcactggctgccctgccatgacgctgctgaggtcagtgcagctcccgccagactcccgtgacaagtcataacagagccacatgctgggtggctgcagggccctgtcgcccacagcagtcgaggtctcaggtgtgtccggagggcagccctggagacacctgggacaggcgtacctctggcgggcgcaccctggctgtcacccagtgtgggcatggtgggggtgctggaatgctgtgtagggcaggaggcagcagcccgtggctgggtgggagactgcagggtagacgggacgggaccaggagggttgttcgcagggactgccaagccatccccaggtgtcgagagtgtgaggtaggagtgggagcccagagccggctccaggccaccccaactcccgacagctctcggctgttctgtgtgaggggggacggggccgagtgtgggtcggcgcagtgctgaggtgtcccacgtaccccagcactgtgctgaatgcattgaaatcactgcccagggctccgcgagctgcacggcccggctttgtcaatttcattgctgttgatgccaattaggggtgacgctgtccctcccgcatcccagggtgggcagagggaggggccggcttgttccctgggggcaggcgtgcatggattcagcctggccatggagctgtggccaagagggcagcgggggcagctggactggggtttttgccgacgctctaatttggcggctgtcgccacccctcccccccatggagaccctgacgtggcctgagccagactccaggggccatgtgccctgctggggagcaggggctcagcatcaggtctggtgcactgactgggagaggggggtctccagccctggacaggctctgagtggggtggggtcccccagctgctgtgcccagccctgcccccaggacctggccttggccctgcgctggccggggccagggagggagtgggcccagctcccaagtctgtgtgaccacctcggctggggcactgacagcccggggtgcggagggcccagcccgtgacacccgccgtcagccgcgccctctgcctccagcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtaagtgccggtgggtctgggggcacctcccgtggcggcactcaccactctgtgtcttcgcctccccacaggtacatgtccagggccgccgggtccccttccccattgccagcccctgaccctgcacctaagtctgagccagctgctaaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 97 - DNA, 1555 bp, Homo sapiens
gaaaaaacccagccccgacaccctccgggcggccggtccccacgccctctcactgcgccctcggtccgccccagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtcaagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtgcagaaggtcaagagtgctgtacggtgctctcacgtctgggacatcactagccgcttcctggcccagaggaacacggaggagaacctggagctgcagatggaggactgtgaggagcggcgggtgcagctgaaggccctggtgaagcagctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaccttgcctgcgacccagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcgacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccagg

SEQ ID NO: 98 - DNA, 1911 bp, Homo sapiens
agcagatatggggtctttaagggtcaggggcatccctgcaccggggcatggagccgaaggctggatttcattcccctcttgaactgtgaagaatgtattgtgggaggggcaggcagaagtccatgcccagaggcccccagaagcatgaggctggggactccggccctgcagaaaaccccagaacaatgatgtctgtcctcagcggggccatgtggagtgccacctcgaggagtgccaggccctctcctgcccccatggctgggcgaaggtgccccaggctgacagctgctgtgagcgatgccaagctcccacccagtcctgcgtgcaccagggccgtgaggtggcctctggagagcgctggactgtggacacctgcaccagctgctcctgcatggcgggcaccgtgcgttgccagagccagcgctgctcaccgctctcgtgtggccccgacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgctgtgggatgggcagtcccaggtggaggtgagcgtacctggctcctaccagggccggacttgtgggctctgtgggaacttcaatggctttgcccaggacgatctgcagggccctgaggggctgctcctgccctcggaggctgcgtttgggaatagctggcaggtgcaagagggccgcgggtatcccccagggctggagctgccccctgtactgctgcagatggagtggagccggcgggcccaggagcagctcctgtgggacttggaactgctgactggtgtggagctgggcctcttctggccaccccaggcccagtttttcggtccgaggggccaggcccagcaagcatggagccagtgctgtcagccaggtggtagcacaggtggggaccctgagcagccgatactgaaggccagctgtgatggctcacgcctgtaatcccagcactttgggaggccgaggcgggtggattgcttgagcccgggagtttgagaccagaatgggccacatggaaattgggatggcggttcttgttaagctcccctatgccgcccagcaggaaaccagtcaccgtgtcctcgtctccgatcactgcgatgagcttacccctccccgccatccctgcagccgggcagagctcaccctagagcaccagaagccactgaaaccccgcctccgccgtacggcgccccgtcggcctcaacccccacccttcgagcatgcgcagtcctcccagccgcattccgggacatgcgcattaacagcaacacggcctccatgtgaatacgcctgcgccgtaaagacaggcccgaaccaggggactacgattcccagaagaccgcgcggcaccacgtccttcgcgggcattcattcgttcattcactcgttccttggttcattcgttcaacaagcgctttggacctgacgctgttagacgccgagaccccagagaagagacgcagttactcatctcaagggcagggtctgggtctttatcgtgtatgtatgtgtgtaactatgacacatagttaacaagtaacacacgtttgttcagttaaaggaatgcaaaagtt

SEQ ID NO: 99 - DNA, 3004 bp, Homo sapiens
atcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtagatgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccaaacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctcc

SEQ ID NO: 100 - DNA, 2027 bp, Homo sapiens
tctaatggggctgatctgggtcccaactctgaatcctgtgcttgagggtctcctttcctgttcttgccccagggttaggcaccccaaagattccaccaattcctgtacgggcaacatatactttaaaaaatttacggctgggtgcagtggctcacacctgtaatcccagcactttgagaggccaaggccggaggattgattgagtcccagaatttgaggccagcctgggcaacgtgacgaaaccccatctctacgaaaattacaaaaattagctggcatggtggtgcatgcctgtagtcacagctacttgggagactgaggttggaggatcgcttgagcctgggaggtcatggctgcagagagccatgatcatgccactgcattccagcctgggcaacagagcaagaccctgtctcagagaagaaacaaaaattactattaccccacctacttctgaaaaaaggatatgagtctatggcttaccaatacaaaacttaaagaggaagaaaccaaaatctgagtataaggataaaagagccaagcagaaggatagtgaactcagggacatcagggtagggaaagctgcagcagtgatggagcacaaggctttgctatgagcttcctggaagccaatgtaaagaagaaactgagctcatttgcttgctaaaaaacaccagatcatcagggagacatcctttccccggtcttgagctagaagaggatatttgctggatgggtctttctaaaagggtcaaagtactggctggtgggaggggtcaccagcagcaggtttgcccaacacacggaaacgctcctccctgcattgctgcctccccatcgagcctccttggcagatagggatctcaggcagagtcgctttgtaaaggctattccagggggctcgggccagggctgtgtgacatgagagtagctcagagggacttgctgtgggggtggccctgacatacagggatgagagaggagtgccaccccgagcttacccttctgggacatgaccccctggactggctgctgaatttgtgcaacagcagaggagtcacagttgattttctggccctgccagcacctgcggggcaggtgttttctgtgacagttggaaataggcccatgttcttcactctttcatccagcaagtgctttccagcttatgccaggccctgggctgagtactgtgggcacattgggcaccatggcagacacaatgcctgtggtgataactgccacccagaaaatagccaggtgctgcaggagcccagagggagacatggggatgaccaggaagcctgggggtggcagggaaagctttctgcaggtaatgtgggagctgagatttgaaaaatggagggaagttagcccagtggaaaaggagagcaagaacagcaggtggtgggaacagcatgcgcccaggcctagagccaggacactgtgtgctaagtttggggaagatgatggaaggagatgctgttggatgaggtggaaggggagggggaccgggccagcacaggtggtgcacacctcaccacagagcgtggcttctaccgtgaaaggggagggagggccaggcagggacaggagggaccagggtgacgtggaatggggagaaggcagagtccacctagcttttgcccgcatagatggcctcccggcctatgggttgagggcagccgactcctgcctcccaacctgttcacatggctactacctggagctgtccttctggagacacctgaggacgaccagaaaccataacgaggacgccttttcacatccttcgcatggcaggatccttctccccactgcatagatgtggaaactgacctcaagatgactgttttaaagctatgtgggctgggggcagtggctcacacctataatcccagcactttgggaggctgaggtgggcagatcgcttgagcccaggagttcgagaccagcctgaacaacatggcaaaaccctgtctctgcaaaaaataaaaaattagccgggtgtgattgcccatgcctgt

SEQ ID NO: 101 - DNA, 1916 bp, Homo sapiens
aggtccagtgaggacgagggtgaaatttatatctctgcccaggtctcggtgcctgcaccgccatagacaccaccagggcactggggacgctgggtgcactggagcccgagacccctcttcctggccatggctgtcctggtcgccagtactgtgggctgtgattctgagtatcctattgtccaagggagcctctccccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggctcggggacgcaggcgctgctgcagaccacgagcgcggagcttggggaggcgcaggcgaagctgatggagcaggagagagccctgcgggaactgcgtgagcgcgtgacccatggcttggctgaagccggcagggaccgcgaggacgtcagcaccgagctgtaccgggcgctggaggccgtgaggctgcagaacagtgagggttcctgtgagccgtgccctacgtcgtggctgcccttcgggggctcctgctactatttctctgtgccgaagaccacgtgggcagaggcgcagggccactgcgccgatgccagcgcacatctggcgatgtagggggcctgggggagcaggacttcctgagtcgtgacactagtgcccttgaatactggatcggccgcagggccgtgcaacacctgcgcaaggttcagggctactcgtgggtggacggagtcccactcagcttcaggtaggggaagggctcctggtgaaacctgggggccacaggttagactctagaggacatgttttgaggccgaggtgggcggatcacctgaggtcaggagttcaagaccagcatgggaaacgtggcgaggccccgtctctactaaaaatacaagaaattggccgggcgtggtggcacacgcctgtaatcccagctaaccctggatgctgaggcacgagaatcacttgaacccgggaggcggaggttgcagtgagccgagattgcgccactgcactccagcctgggagacagagttagactccgtctcaaaaaaaaaaaaaaaaaaaaaaaaaaaaagacatgctttggccagatctcagggaccccttggctggggctccatgcttagggatgggcaggctggaccctaggaagtgtccttgggttaaattctgggcgttagtaagttatatcccaggtgtatactcaggttagacacttggggtgtctagcgtagacccaggcaataaacaggctagagcctgggaaggaagtgggggccccgggtccatccttagcttagattcccagcatcaccccccgcccggccattcaaccactgcagccactggttacagggggaacgcaatgaattttgggggtgcgaggcctgtgtcatgattctgggcatggggctgtggatcgacgcaccacgtgatgagaaggctggccggatctgtgagcagagggacggtgctgaccccgcccggtgccccagagccgtgcccagtgcccaaaggggtgctgtgcaccatcccggctcctggaacccactgccaaggattttcttttccccatccaccactgctgagaaccaatcggccaggcccagccctgtccggtgcctgcactctgggacctctgctctgacttcatgcaaacctaacctaaccttcactggctccaaaatctccatttctggatcccagtggtctgaccccacctctcctcctagccaaggtcaggcaactgaggaatggagctatttggttttcctgcacgttcccgcaaaggggaaaatggtacttcctgcaaagctctctttgcagcctgggggagcatcaataaaggtttgagaaatg

SEQ ID NO: 102 - DNA, 3517 bp, Homo sapiens
aaaatgatgagtgtgcgaccagactgcggcagagaacgagccatgctctctgagtgtaaaagctgcattgtgagcacacgtgacgatccgaaggagttaattctcccccgggggctgacttgttccacagaaggggcgacaggcctggagagcagtttgaagccttttcctccacgagggctgtgggatttgactcccgcagtgctgttgttgacagtttctctgtgtgatgggggaaacctttgctgaagccttttgaaacttttgatggccgatcaaagaggagtgattcgtgaaatcggttatttttcccacctgctgaatgtgaacagtaaaacgtttttgcaaaaccaaaacggggagttcatctggcttcaaaacaaggagaccagccctgcaaagcagcgttgactttccactggacccaaaaagtgccgttttgacctcagccaagcattgcaggctgtgaacagcagagtcagcttttgaggatcctccagaaccctctggaagccctatgaggacacttcttaggttttgatacacttgactctatccaacacttacctccttgccttgggtctctgggtttaatttcctgctgtgttatagcaactaaagggaaaggaacgatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagttccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattgggggtggcctatcccccttgccccacctcacagagtcctctagcttcctctccactgtgacttccgtgtcccgggactcccccatcgggaacctggggaaggagctgggcccagacttgcagatgtgtccacccgcccctttgctcatcctcatcttggtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagaattgttgtggatatcccagaattaacattgaggaggagactttaggcttcaccaggctgccagctgggtccacggtaaaaacgttgaagagccttgggttgcagagattggaggtgagaggagtgactctgaagtaaagcagcagcagtggagaaggagtggagggcacacacctgaaaaaaacggagcaagtagagagtggccgggcctggtggccggttcatgagacgccgtggagcaacaggcacctcgcacggctgtcaggtttctagtacgggtgcctgggcgatgggccatcactgagacaggaacgcagagagacaaccagttgggatggaaaggggacaggttggatttgaggtgtgtgtcatcacaggcactgggacttgaaaagggctgggctgaagatgtatatacctgggtgtgaatgaggaggtgggaggcagggccatggaggacgctgcaggactgtgcacagaatgaaaggaactcatagaaggaaccaaaatattcattttccagaaattagtgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtggtctcagtactttgggaggccaaagatgggaggattgcttgagcccgtgagtttgagaccagcgtgggtgacatggcgagaccctgtctctacaaaaaatt

SEQ ID NO: 103 - DNA, 1904 bp, Homo sapiens
acccgctgagcatctactgcgagcaggaccgcgcgctggtgtgcggagtgtgcgcctcactcggctcgcaccgcggtcatcgcctcctgcctgccgccgaggcccacgcacgcctcaagacacagctgccacagcagaaactgcagctgcaggaggcatgcatgcgtaaggagaagagtgtggctgtgctggagcatcagctggtggaggtggaggagacagtgcgtcagttccggggggccgtgggggagcagctgggcaagatgcgggtgttcctggctgcactggagggctccttggaccgcgaggcagagcgtgtacggggtgaggcaggggtcgccttgcgccgggagctggggagcctgaactcttacctggagcagctgcggcagatggagaaggtcctggaggaggtggcggacaagccgcagactgagttcctcatgaaatactgcctggtgaccagcaggctgcagaagatcctggcagagtctcccccacccgcccgtctggacatccagctgccaattatctcagatgacttcaaattccaggtgtggaggaagatgttccgggctctgatgccagcgctggaggagctgacctttgacccgagctctgcgcacccgagcctggtggtgtcttcctctggccgccgcgtggagtgctcggggcagaaggcgccgccggccggggaggacccgcgccagttcgacaaggcggtggcggtggtggcgcaccagcagctctccgagggcgagcactactgggaggtggatgttggcgacaagccgcgctgggcgctgggcgtgatcgcggccgaggccccccgccgcgggcgcctgcacgcggtgccctcgcagggcctgtggctgctggggctgcgcgagggcaagatcctggaggcacacgtggaggccaaggagccgcgcgctctgcgcagccccgagaggcggcccacgcgcattggcctttacctgagcttcggcgacggcgtcctctccttctacgatgccagcgacgccgacgcgctcgtgccgctttttgccttccacgagcgcctgcccaggcccgtgtaccccttcttcgacgtgtgctggcacgacaagggcaagaatgcccagccgctgctgctcgtgggtcccgaaggcgccgaggcctgagccgccggacgggtagtggaggggcgcgggggcctgggttgaagcttaggtctccttggtcgggtctgacgggagaagggtggggagcgggttgccagggcccagggggctgggaactgggggatctcccagaatactgacaagcgtgggattacagacatgagccactgcacctggctgaagatgctcattttttttttttttaatttagtttttgtagaaatggtgtctcgttacattgcccaggctgatcttgaactcttggcctcaggtgatcctcctgccttggccttccaagtgctgggattacaggtgtgagccaccacgccctgccaaaaatgtgcatttctagcaggttcccaggtgacgctgctggccacaggggctgacgctgcgggaagccctgacctagtgcacaacccattgggctcttcactgtcagtgtagaggcataggtccaaaatatgtttccccagtcaaaaacatgtaaggtttgcaccaggagtggaaggaaacaaacaaacataaaccaaagcaaagacacttaagggctgggtactcatgcctgtaaacccaacactttgggagtttgaggcaggaggctcatttgaggccaggagtttgagaccagcctggggaacatagtgagaccctgttgcaacaaaaaccagaaaaacaacaaaaagaagacattggaaaatggctggagctgattctaggtgaataaacaaccctcgactt

SEQ ID NO: 104 - DNA, 2100 bp, Homo sapiens
acgccctcgcccccacccgccccccgcgttaattcgcgccatccagggcgctctgtgagtctgtcattacccagcgcgagtcaggcccctcctgtgcccctcgccagccccgaggggcgcccgcacacagtcggcgccccacacgcaagtacctggaagagaacaagaggacgccagcgggcgcggccgccaaagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggcccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatattaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcg

SEQ ID NO: 105 - DNA, 2215 bp, Homo sapiens
acttttattcttcaagtgaatcggaagaagaagaagaatcacataagaaatttaatatcaagattaaaccattgcaatctaaagacattcttaggaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttc

SEQ ID NO: 106 - DNA, 2089 bp, Homo sapiens
gtgaagttgctcgccgggtcgttgggccctgtcgacctgtaggcgggcgagcgagccgctccggtccccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactggaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggaggggacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttc

SEQ ID NO: 107 - DNA, 2812 bp, Homo sapiens
agacgcgagcatgtgcagtttgcagcgcatccgtactatggggacacatggaagctgccagccccccagccaaggatcagctgagccctagggctgatgcttgcctacgttgctgataatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcagatggccaccattatttctgttttatgggagaggtctgttggcaaagagtcggccacccagatttaccacatttctctgcagaacactcttttgttcaatataagcagagaccttccaccgggggcaggatttgtgatacctgcagtgagccaaggaccaggctagttcctgtgatgctgaagatgttgaagggaagcccataacattacaacgttgaccaatcctccagaaaagaagctctaacagaggaccctggctgtctacggggttggtttccatctctccattcgtgagctccttgaaggcagagaacacttggcttttcttcctatacctccagtccctaatgcagggacatgagagatgcccatttgtgtttgatgaatgaatgagtgaataaatgaatgaatgagtgcctggagatcagagtacatgggatgagtgttcggagttctacagactcaggaagccccagctgacattccaagaagaaggagacacgaaggtgaggggatgccatgcagttagcgtcacatgaagaaaaacaaaatttaaggtatcatccttagaagacggagggatgacagtttcaaggaggatttgttcatcagatgctgggaaggaatttcaacagatgaggaaactgaagagcagagaggttaagtacccccctaccctgccccccaggggacacaacctgctggagtgcaatggcacgatctcggctcactgcaacctctgcctcccgggttcaagcgattctcctgcctcggcctcccgggtggctgagattacagatgcaaggtagagagtggaaggaatgaaggggtgggcgagggcatgaagaagcctccccagctctaatggccactgtctgaaagtgatgcagctcacttccacccacattcgccagatttcaatccatagcctcacttaactgtagggcaggctaggacatatcatctttccatgtgctgagaaaaaatagaaaagaccaagattggtgaaaaggagcaaactagtgacgagaaccttgccatagccatttttttgccactcacagaagccggtctgtaccaagcgagaagtggctataggagaagtggtcctgaggctcatctgccttctcctggtcaccctcccaatatatccctcctgtgctgagctagttttctattacttttcatcacctacatctaaaagagacctacctatctaacacagtctttgtcttactatcataatgctattaatgcaagctaaataataatctttcatcttctttttttctttatctttttcacttgaattgctttaaattcaaatcttcctgctatagtgtgaatgtttgtgttccccccaaatttatgtttaaactttaacctccaagctgatggtattaggaagtggggcttggggaggtgattaggtcatgagggtggaatatttgagaatgagattagtgcccttgtgaattaggcctgagagagatcccctcatctcaccatgtaaggacacagcagaaggtgctatctttgaaccaggaagtgagccctggccagacactgaacctgccgatacctcaatcttgtccttctcagtctccagaactgtgagaaataaatttctgttgtttataaacc

SEQ ID NO: 108 - DNA, 3358 bp, Homo sapiens
aacactcagtagatgttagctttcttaaagtataaatattgcccctagaatcttgtttatactgttattacttactaaatccttgtattcatggcttgtgcagagataaatatcacccttgcctctggtccaattatcacaaatgctaaattaatgaagcccaaatcagcttttcctgtatagagggtttgccatcttttctgcagcacacctttgtgcaaagcagtaggcggtagtgccctagcaaacaggatttcagtattctcccttcctccattcatttgtgaaattgtccctgcaccccaatattccatattccctagaacgcttgatagaactcagaaattaaaacccaccccaacctccaaaacatgagtcaccaaaggccagtgggctacgggttaaactctgttgaggtgttgaagtgggtgggtgggtgtgaactacgcttgaagaggctgcagtaagcacttgctattatctgtgcaagttaactagtcccccctgagttgaggctcacagaagcaccgctggcagctcggttaagaaagctgtaattaaaaaggaaatataagcaaacgcagcttgagacgcagccaagggctggcgccaagctcatctcctcctctcttctgcctaaacaccgcagtgaccatcctgcctacccaaaggaggtccctacaaacaagtgcaagaacaatccgcgctgatcactgccctcccaggcaagcgaggggtggggaagtaacgtttgatgagggcctactgtgtgctaggtgttttgcacacattatttgtttaggcttcataacagccctacaaggtaacactcctgtgttgtatagatgacagactcagaaaggttgtgtagcttgccctggttgcatagttaaacgagggctagaaacaggactaggagtcaggcctgtccagctggaaaacttgggttttctagaaggggtaccctggcctcctgcggagcctgctgtgggactctgcagaacacaattcaaggccagactgaacactagcctgaacctgccctgagaatccctctaagccgacctactccacagctgtcctgactgtgtaagcgagatgatgattagtgatcagacgaaaggattcctgtcattggtaaccctctcaaagtatttggaaaacagttcaattttcatctatttcagaagcacgccgtggtgtctattgaggctcacctgcattgaattccttcctttttatgttgcgatctcccaagattgcattgtggagtgttttcgaatccattttgaaatccccgtgcgtgcgctatgcaggcctcagtctttttccattccattcttaactctactttcgacggaagcagtgttttaccccgacactggcttgcctaggaccttgtgctctgcacaactagcagggcccggcaggatgtactgaattcttgctctcgtgtccagctggacggtgatggctttcaagtccttggctgttgggagcttactataaatgttcgtcttggctacaaactctccactctctcctcggcactctctcagcattgccaccactgtctttcctcttggccaactgttttctttacttaggctttcccttgctagaaagtccaggtaactttctccacgggacctggtttccttcgcacatcccagctggcctcgaggaaaggtagctcttcccaaatcagagaatctggatgctgggctgggctctgcaccaaccagctgggccgcttcacccgctgggccccaaactactcatctgtgaagcgaaggcaccgcgcttgatgccttctgcaacgttcttcagtttggaaatccttctgtttcgttggggatatttcacggcctcttctcaaggttgcacttttgccagctgccagggatcgtctcaaaacaggttcttagtgcattcatagcttgagctgctgtcttgaaagtagtacattcctttttctgccaacttttttctgagaaagtttttgaatgcacacgtgcacccaacagagtgagagtggctgttaagagagagggcgccatttcctttgccctccagcctgtccctgtgcaccctggaggggcccgttttttccaccgcttagataaaatctagggcaagttcctgaacttctcttgtctctctcaggtaacaaaaattcttttgggctcctttagtcacaaagatattcacgatttcaggtattaaagtgcccagccctgggtgattgtcaaaattctgaacttgatttaaagtggcacctcctctcacagtcttcgggagggagagaccggagccaggagtgcagcgtgtttgctggggtctgtcgtggcccactccacacctgctgggtggatccggctggtgccccatgggcgcctctgagatgcccctccccaccccatcagtggcgctgtctcacctgcaggctgcttctcacaggtggtcccccctcactcctcctgcagccccagttcctggctgttcattcttattgggacccgtcaccctcctggaggcggtcccagccgagcccccttaagacagcaccaggctggctccacttggcccccgctggttcagggaagtgctgctgcagccgtttagtttgacaaaggaggcagcgaggccgtctcattggtagccctctcctggcttgcccagccaccacctcacctcgattcctcccaggcctgggtccagcaccagcctaggaagagggtgccccatgctgtctagctcttcttcgggatggggggctccaggttccttggtattttgctttggcctttggagcctcagtcaaaactgaggaaaggtgtcattttcacatctcgtcacacgtacagtgactgcaactaaaagcacaggctttgtagaaacagacatgggttcaggccccagctccaccattcacaaggtgtgtggcttcctgcaaggtaccttcatctctgagttacctgactccatctgagtttccttcttgtaaaactggcatccgtgaaagtggctacctcgaagggcgtgaagatgaaatgaggtggaaagtaggtagcccccgaatgagggaagcattgagtgagagctggccctctgacccttctaaaagaacacagccaactttttaaactgtctttccagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtc

SEQ ID NO: 109 - DNA, 3081 bp, Homo sapiens
ctccctgatgcgtccccaccccaggccctgcccacggcccctgatgcccacagtagcccccactgcagcccgggaaatgggtgtacatcacacaggggactcaggtgcacatttggaaataaaggacaagcaagaggccagaaaggacaaagtgggagcaggagaccttagaactggggagggggagagggaggggacatgtggcaacagcagctcaagtgactcaggtctcgtatccgcacctcagccatttctgcctcccctacaagccacagccactctgcaagaggaagctggggtttgtggttcctgttttgcctgggaagaaagagtagcagtgaagagggggctggtgggagctctgacacatttcggcgtcattaatgcttcccccaggggcggaaggggccggattggtggctctggggtgcatcccctcacctatgattaggcttgcaaaaaagaacttggctaaactttatattgtggatatctgtgtctgcctcccaccttcctgtgacttccttgatggcagatgccatgtatgaaacgctgctgaatttctagagccctgcacgttagtaggattccattttccatcagctgagtgacctgggaggcacactagagagggcacatttcttttcttttcttttctttttttttttgagacagtctcactctgtcacccaggctggagtgtagtggcgcagtctcagctcactgcaacctctgcctcctgggttcaagtgattctcctgcctcagcctcccgagtagctgggattacaggtgcgtgccaccacacctggttaatttttgtatctttagtagagacagggtttcaccatgttagccaggctggtttcgaactcctgacctcaggtgatctgcccaccttggcctcccaaagtgctgggatgacaggcatgagccaccacacccagacgagagggcacatttccaactgcattctgaaggcctggtggtgagaaagagcatatagaggtggcacagcccatagcagagatgaggccaaggacaagaagagaatgcaggatgccgctttccacctagaagaagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaaggttcggatgatggctggggtatgtccctgtggggcttgctcacctccaggccccccgcttatatcttctgccttttccagggtctgctgtggtacattgttcccttggtcgtagtttactttgccgagtatttcattaaccagggacttgtaagtgaggggtgctaggaggggtgtggaggtggcgattggggctgggacccacacagccccgtccatctcccctgtctggtatttgttgcagtttgaacccctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccctgcaggggggccagccattgtctcccacttggggagtttcttcctggcatcatgccttctgaataaatgccgattttatccatgg

SEQ ID NO: 110 - DNA, 1964 bp, Homo sapiens
tgttctctgcatcccctcaccaccttcctttgtgacaagcagctgaggtgtctgtaacccgaatcaatactggatcagctccttgaagatagagattgggtcacacaattatccttatatcttagagcacagcacctgcctggtacatagctggcattcagaaaatattagctacgcaaaaatgtgtttaagtattataaccttgagttgatgaaactctgaggcaagaaatagtatttatagaggatttcatgaaaaatgtacaatttatcgatctcatcagttctcagatttggctatatattaaaatcccctggaaacatagaaaaaatcagaatctctggttggtggagtcctgtgttggtattttgcaaaagttcccaggacttcctaatgtgcagctagggttggaaaccactgctccagaaaatccacattttaccactgaagaactgcctgcatatcctgtaccatttaggccctgcactaaagtgcctttattgaattatacttgggctttgtgtccaatttgactgaacctgggatataactgtgcgactcttgtcaccggagatatggggagatgttgttgtcaatggatcctctttatgaagacacaccagagagatgcctattgggcatcagcaccaaaaaaaggccatgatcctcctgagcaaccagttcatgtttgtcttacggattccaggaatcatttaattaacactattttccaggtttgtagtagctgctgcaaagctcaagatcaaagtcatggtgcatctttatcacctacaaagaattttgtggtgtgtgtgttacatattgacttggttctgcattattttttgtctttttctcttcaccctctgatatggtttaggtctgtgtccctacccaaatctcatgtcaaattataattctcaatgttggaggaggggcctggtgggaggtgattggatcatgggggcagacctcccccttgctgttctctcaataatgagtttttatgagatctggtcgtttgaaagtgcgtagcacctcctcctttgctctctttttcctgctggccatgtgaagatgtgcctgcttccccttcgccttccgccatgattgtaagttttctgaggcctctccagaagcagaagcctgtatagcccacagaactatgagtcaattaaacctcttttctttataaattacccagtctcaagtatgtctttatatcagtgtgagaatgtatgaatacaccctcctttccctaactttttctataataaagctttttaattgagataattcacatatcataatattcgcccttttaaagtgtacaatccagtggtttttagtgtatttacaagattgtgtgaccatcactactaattccagaccatttccatcaccccaaaaataaactccacacccattagcagtcacttctcactctctcttcccctcgacttactttctgtctttatggatttgcctgttctagatatttcatatctagatatttcatataaatggaatcatacaatatgtggctttctgtgtctggtttcctgtacttagcataatgttttcaaggttcatccatggtatcagtagtttattccttttttatggctgaatagtattctattgtatggacataccacattttgtttatacattcatcagctgttggacatttgggtttctactttttggctattatgaattatgctgctgagaatattcatgcacaagtttttatgtgaatatgttttagttctcttgggtacatattagaagggtggtttgctgtgtcagatagtaactctgtgtttaactttttgagaccctttcctcatttaaagaaatgtttttgtcttatagtatagtatgtatctctgtaagccactacagattcctctttttggaatgaggtggcatataaataaataaataaaaagtcacaaagc

SEQ ID NO: 111 - DNA, 3320 bp, Homo sapiens
gatgagacgggaaaaggtggagccagtgggcacggtgggcggtgcggagggcggggctgaggcgcctgagcggggcacaaccctcctagaggcgggacggtttcctgccaatcactgctggtttgccctccccctggtgttggcccggctgactcggggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatcgtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgattttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggtactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctctttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtc

SEQ ID NO: 112 - DNA, 1882 bp, Homo sapiens
atgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgcggctccagggcgagtctgggtgggctgcctgctgggagcttcagtcctgtttaggcctctgtatctgtagagggggtggggatgccagctacctcctagccaaaaaaggcaaggagtggggtacaggggtgtgaggggaggtggatcagggtcagagatctccccaggcagtcagaggagttctgagttctgagcccgatttctaatctcggctcagcctcttaagccaccaccagcctcctctgggccacagatttctcgtctgtaaagtggggaatgggaagggtcagtggcagtggggaggatgtcagctgaagtctcctgggggggtgtctcaggttccttccaactctcatgtggaagagtaatttgccccctgcccccagcaggaaacacaactcgtaaattcgtagaataagggtgtacacttctaatccggaccctaattgtgctttgtcctctgcaaggcccgaatgcccatgagaaagtgaatccccggaagggggttgcatttcacctggggcccagtgcagggatggcagcaggagaaggtgccctcatgcaggagctgtgggcagctcctcctgtcatctgtctttgcccagggctggcacagaatgtatccacttggccttggccagggtggtgtttcttccaaggggagcctccacctgtccattctcctcccctacagcactggccgcactgaacacagtgcctggggccatgatggaccctgggcttcttaaggcccctgtccttccctgctccccagtctcaggcctctccacacaggtgctgtgggatgggcagtcccaggtggaggtgagcgtacctggctcctaccagggccggacttgtgggctctgtgggaacttcaatggctttgcccaggacgatctgcagggccctgaggggctgctcctgccctcggaggctgcgtttgggaatagctggcaggtgcaagagggccgcgggtatcccccagggctggagctgccccctgtactgctgcagatggagtggagccggcgggcccaggagcagctcctgtgggacttggaactgctgactggtgtggagctgggcctcttctggccaccccaggcccagtttttcggtccgaggggccaggcccagcaagcatggagccagtgctgtcagccaggtggtagcacaggtggggaccctgagcagccggtgagtgggtgagggggcacggcggggacagaggttctgggaacactggggccctgctgtggtgagggcaagcggaaggggcagggttttagagacagggctgggtttgaatctccacactgaccacccccgtgggctctgagtttacctttcctcagctagaaaatgcccacgaggccaggcgtggtggctcacgcctgtaatcccagcactttgggaggccgaggtgggcggatcacctgaggtcgggagttcgagaccagcctgaccaacatggagaaaccccgtctctactaaaaatacaaaaattatccaggtgtgacagcatatgcctgtacctgtaatcccagctactcaggaggctgaggcagcagaatcagttgaacctgggaggtgaaggttgcagtgagccgagatcgcaccattgtactccaatgtgggcaacaagaaccaaactccgtttcccccaagccccccggcc

SEQ ID NO: 113 - DNA, 1908 bp, Homo sapiens
gagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggtaagagaactgattatggaaaattgtaccatgttctctccctgatctctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccgaaccctaaacatatattccaaaactctattcagtttgatttcttcatgtttttatgtctatcaaattaaaaagttgacgttggtttgcgt

SEQ ID NO: 114 - DNA, 2982 bp, Homo sapiens
cagtgtacttggggcttcagtttttctcgctgtgggctgccactaccattgtcgtttgctgagggtggcagctggggtaccagtggtcttctagtgtgagtattccacccggcgtttagcggtacctgcacccctgcgtaatgggtgggacctcctatctgtgcttggtctcgggcaggacttcctacagctcctcctggaataaggagcattagttctcctctcccacagttgcagtatttttgctgggcccacagggtggacaggctttggggcccctccaccagcaggttaagccttttgctttgcacgagaaaagggcccagcagagtgcttgatgattcatggctgtcagtcagttgcttctgcctgctatgagacatctctcctgtttttcctgaccatctttcttgaagcacccatgggaggcaggtaccctgtggaagtcagaaggttgtctgggaatgtgagctccctgtgtcgggcacatctggctttgtttgagccaccccatgctcctgccagccaccatctggccctgggcagctgactgcaattcgagctgatttctccctgccctgttaggtgctagcaggtgtcctgtccatccgggctctgctgaggggcagttctctttcccatcttgggaagttaggttgtttgtgtgctttgcaaccccagctctctgatgggctcaagaaaagatcttgaagtttatgtagctttttctactgtagggtcagtgacgttctttgcagttttctgtattctaagcagaaactggtcctatttggaatttttattttgaattttgtcagaaaataagtgtgtctctttgaggatgcatatttgtatacacaggtgcatttatcattgctgcataatctatattcatgttacagttgacttcctgcttattagaaatgtaaatcctcttgaacataaaatctgaaaggcaaaagtctcacatccaaggtatttcttcaaggccatcattgaagctttcaggttagcttggtagatgtcatgaaagtctcagggcccctcagatgtgatgggaaggttgctggaggacaccctccctctgttatccctagcaaatcccttccaggaaggctcctcagagcctcgacaggtacacagtggactccctccctctgcggggacttcttactgagaaacttgattgtagatggaagcttctcagcacattccaaactgtgaccatggatcagtgtgggccatgttccagttgaacatactaggaagtgctttgctctgtctcagtccccatggatgcagaactctacagcttttgttttccttacactctaaggaacttgaatagcatgtaagtgcatttccagatacacagagactggaggtaactgtacaggagaggtctgcttaatcactcctctttgcgtatgtttgagacaggtgctcagtaatccagtattacagatgatttaaatgggtaacctattttcatttgtctcgctgatttttaaacattgtctttttgtaattcctttttgtagacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatag

SEQ ID NO: 115 - DNA, 2608 bp, Homo sapiens
catccccctccctctgagtattaaggactcacctgatttttcctcatctcaaatctggaaaatttagaaatgcagagtgaagaaaataaaaagaatcacccctattctcactgctcagagagcaggactgttaacatttcaatgtatattatgggtccagtctctaataaggtgatttatacaaagcctaatcaggagtgtgaggacctcaaggccagatctagggcactagtgcccttccactttctggatgagtgtgtgaggtccacaccaggtacaagatttaagggcacccagctcctggccttttgttttactgactgggctctaacaagctccagctgctcctcaagttatgatggctggggctatatcctgaaaaacccatcgtaagttgaaaatatcatttttgacttaggatatttacaacttacgatggccttatctggacaaggccatcgtaagtcaaggtatgtgctgatgcctacagctttcagaccattgtaaagtcacaacgtcaaatcacaggtcaaaccattgtaggttaggggccgtttggaatcagtcagattaaaaggaagcctagtatgtgcaagtactgtgctttccacacaatgtcagtgaagcccggggatcattaacacggtctctgctctccgagtagcttacacagcgaagtcagacaagccctcatgctgttgatattaagcgctgcaggagacgagagaaaggagaggccatcctgcattaggctctcaagaagcttaatggcaaaactgggacttgcccccccctttttttttggacagggttttgcgctgtcacccaagctggagaggagtggcatgattacagctcgctgcagcctcaacttcttgggctcaagcaatcctccctcctcagcttcccgaataggtgggactacaggcatgcaccaccatgcccggctaatttttgcattttttgtagaggcaaggtttcaccgtgttgtccaggctggtcttgaactcttgggctcaaacaatcctcctgcctcagcctcccaaagtgggaggccactgagcccggccctaagtcttaaagtaaccccacctctgtgctccaggtttccttggacaggaggggtggagcttctgtttttctatataaatggggctgggggcagagaacaacctttctttttattttattgagacagggcctggctctgttgcccaggctggagtgcagtggtgtgctcatggcttactgccgcctcaacctcccgggctcaagtgatccctctcaccttagtcacccaagtagctgggactacaggcgagctaccacacccgggtaatttttgtaatttttgtagtgacaaggtcctgctatgttgccctggctggtctcaaactcctaggggctcaagtgatcctcctgccttgactcccaaagtgctgggattacaggcatgagccactacgcccggcccaacccttcttattctttgaggtgaaactcaaaatgcttcttctgcctatatacctttaatcccttgctcctacaccccatggccctgcagcagtggtctgttttttttgtgtgtgtggtttttttttttgagacggagtcttgctctgttgcccaggctggagtgcactggtgcaatctcggctcactgcaagctccgcctccctggttcaagcagttctcctgcctcagcctcccaagtagctgggaccacaggcgtgcggccaccacgcccagctaatttttttgtttttttagtagagatggggtttcagtgtgttagccaagatggtcttgaactcctgacctcgtgatccacccgcctcggcctcccaaagtgctgggattacaggcgtgagccacggcgcccggcccagtggtctgtttttttatcgtgaaacaattcatttcacctgcaacattactagttttcacaagtgcctcccgcactgggtggcgtcctccgagctgggtttggagataaagtaacagatgagacacaggcctcatcttcacagaagtggcacaaacttgtctggggcatggggggtgtccctaaggtcacaaaagatgtgaaagccgcttcaatctgcaggaaaggagatggattaggagtcttcaaagaagaaatgatgccgagcagggactcctgagtggacagtgtgtgcctgctgcatggcacaggccggaacatgtgtggctggggcacaacacttgagatacctggctacaaacagcaacatggggactgcacggtcccacgaaggacacggcaggaggtaggaaaggctctcgttctctacagcaactcttccaagtcctcatctctctctacctcagcaaatgcctccaggctgccaggcgctctgggcagtgccactgaaggcttaccgggctcgctgtcgatctgggtcagcacgtcctcgatggagtccccgtcattcctcaggctctcagggtccggtggggtgtagccatgacagcggcaccagtgagcgatgtgcttggttttgaggggagtcaggtggtgaaatctcggattcttctccaggatttcttgtaagactttttgcattgtcattgctctttgccactt

SEQ ID NO: 116 - DNA, 1806 bp, Homo sapiens
atgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagcttggaatcccatccactgccagcacattgaatgccacaatgcaattaacaaaccagctgtgaagatgtgtatagacccttccctgtcagtagcgttgggtgataaaccacccccattgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggtctctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttg

SEQ ID NO: 117 - DNA, 1866 bp, Homo sapiens
agatgccaacatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccaccttccaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttccgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttattt

SEQ ID NO: 118 - DNA, 1476 bp, Homo sapiens
aaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccggacacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttgggacctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgtttt

SEQ ID NO: 119 - DNA, 1919 bp, Homo sapiens
atatctctgcccaggtctcggtgcctgcaccgccatagacaccaccaggtacagcaactggggcgggagctacgaggaggtccccggagggcactggggacgctgggtgcactggagcccgagacccctcttcctggccatggctgtcctggtcgccagtactgtgggctgtgattctgagtatcctattgtccaaggcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggctcggggacgcaggcgctgctgcagaccacgagcgcggagcttggggaggcgcaggcgaagctgatggagcaggagagagccctgcgggaactgcgtgagtgcgtgacccatggcttggctgaagccggcagggaccgcgaggacgtcagcaccgagctgtaccgggcgctggaggccgtgaggctgcagaacagtgagggttcctgtgagccgtgccctacgtcgtggctgcccttcgggggctcctgctactatttctctgtgccgaagaccacgtgggcagaggcgcagggccactgcgccgatgccagcgcacatctggcgatgtagggggcctgggggagcaggacttcctgagtcgtgacactagtgcccgtgaatactggatcggccgcagggccgtgcaacacctgcgcaaggttcagggctactcgtgggtggacggagtcccactcagcttcaggtaggggaagggctcctggtgaaacctgggggccacaggttagactctagaggacatgttttgaggccgaggtgggcggatcacctgaggtcaggagttcgagaccagcatgggaaacgtggcgaaaccccatctctactaaaaatacggaaaattggccgggcgtggtggcacacgcctgtaatcccagctaaccctggatgctgaggcgcgagagtcacttggacccgggaggcggaggttgcagtgagccgagattgcgccactgcactccagcctgggagacagagttagactccgtctcaaaaaaaaaaaaaaaaaaaaaaaaaaaaaaaaaagacatgctttggccagatctcagggaccccttggctggggctccatgcttagggatgggcaggctggaccctaggaagtgtccttgggttaaattctgggcgttagtaagttatatcccaggtgtatactcaggttagacacttggggtgtctagcgtagacccaggcaataaacaggctagagcctgggaaggaagtgggggccccgggtccatccttagcttagattcccagcatcaccccccgcccggccattcaaccactgcagccactggttacagggggaacgcaatgaattttgggggtgcgaggcctgtgtcatgattctgggcatggggctgtggatagacccaccacgtgatgagaaggctggccggatctgtcagcagaggcacggtgctgaccccgcccggtgccccagagccgtgcccagtgcccaaaggggtgctgtgcaccatcccggctactggaacccactgccaaggattttcttttccccatccaccactgctgagaaccaatcggccaggcccagccctgtccggtgcctgcactctgggacctctgctctgacttcatgcaaacctaacctaaccttcactggctccaaaatctccatttctggatcccagtggtctgaccccacctctcctcctagccaaggtcagacaactgaggaatggagctatttggttttcctgcactttcccgcaaaggggaaaatggtacttcctgcaaagctctctttgcagcctgggggagcatcaataaaggtttgagaaatgg

SEQ ID NO: 120 - DNA, 1701 bp, Homo sapiens
agacgctgcgtgcaaagcactgggtgctgatgtggcttagcatctcctgacacctgtggcctgtcctccctccagccgggtgacacccagacccccagctcctgcacacccctgggcaaccctgctgtgcccccggggtgctgagcgtggctttgccagtgggtcagaggcatcaattgctaaaacaattcggcagaaattaccatttagaacatctttgctctagagttgggcacttcactcacgtgtttgtggacgaggctgggcaggcaagtgagccggaatgcctcattcctctggggctgatgtcggacatcagtggccaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtacgccctgcccaggcacgcctggttctgtgaggtccctgcagccctgctccttggctcctgcagctccacagaggcaggaacaagctccttgtgagcagcagcaggtttttaaaggggcaggaccgcacttgaatgtcgttcaacatgagaggtcacccaactgccatccatgggccagttccgggcagctgccagcttttctacggccagagcctcgaacagtctttacatttctaaatggttacatttatatgtcccttgatatttggccctttgggaaaacatttgccaacccccagctctaacccagtgtttctcaaagggggcactttgggtatatttgaatgggacgcttctcatttcgtatgactctgtgatgtgattataggagagttagcgtccccaggccccaggggctggtcccaggaagcatctccacacgttcacagtggctctggagctctggtggggacacaggtgcctcccatgccgaacaccaggtttcattcatgaagcatgtgtccctgtggtgttcacaccaccaagcagaacttggaaagaacccccaaaatacagaagaaaaggtgagtcccctaggccatcacagtaacagatcacctgtaccgcgcgtgtgctgaccgcagagcccgtcaaagatgttatgtttccttttttctgacctcggggactcgagaggtgagtgcttagttctcccagaggtacagagattacgaaggcttatggagacaagtaagttgccagacatcacacagccagtgtcctggtgtcttaacctcagcttgtaggtgccatcctgctgagacatccagcttagagctgccatcctcagctctaagcatcagacatgcatctcgtttctcctgaaggatttcctccatccttgatgtgtgcttgtggggagggaggattttccacatgaaacttggctttcctagtaagcattgtcccccgtccccagtttaactaaaactgcaatttgtgttctaatcaattcagattagaagaaagcaataaagaattaaaaaac

SEQ ID NO: 121 - DNA, 2381 bp, Homo sapiens
agttgagcccaaccttccagccaactccagcagggtggcaagtatgagagtgaggatatcttggagcctcagcaacctgtgctatccaatagctatcagccacatgtgactactgagcactcaaaatgtggagcatcctgcatgattctatagcactcaacaggtgtctgccaagcggacagactacagacccctccggccgcatgatgctgagcttccccttggacacatgaagattaagttagtcaagcatggagattcctccctctccttcacaaactccagatgtttggcatctccccaatatcctaagacctcctggactgggaacaaaatgagcgtagtgaaagaggaagcagctttagagaaagcaccacagggaacaaaccaataaaaaagcaggaaactcagcacaagcctgatttatgtcactgcacttctctactctcagccccattcccccaaactcccagcaagcacacaagcacacacaggcacacacatgcacatgcgcacacacacatgcacatacacaacacacacacacacacatgccttctgccagcagctctctttctcactctcacttttcttttcaaatgctggcatttgaaaaaatcccctattttgtttcaccctccttttctgcctccctaaagagcttccgaagaggagttttgatggtgcatctgagtgttaatagattcgggagtgtgaagctgttgcctgaatctcattccctgagagtgcctttctctttttaatagctgagaaagaattgatcaagcctctgttttagtctctgtttctaaacagaaagaaagaaagaaaaaggaaggaaggaaacaaggaaggaaggacatacaacgtaaaaacaaaaacatttttacgacgatccctttttcaacagctaggggcaatccagtgtgttcagttgtgttagttctgtgtctgtcaggagaaaaagccatgtagaagtgatgatttagttttcttggtgggaacacaagggaagctagttgaaagcaatggttgtggggtcttgaatggacaggcaagtccggtagtcagaagaagattttgattagaaacagaggaatttcttccaggaaaatacattgtcttcatgacaaaccaaaaatacaccaaatgttctgaaaactgccctttaaaaagaaagaacagattgttcaattgaaacactttcctgaagccaattgttgcaggctgccagccaccttcagtaccagccacccctccgtcctccccagggccggtataaggggtgcatgagagacacgtgcatgcagaagactccaccatgatgcctggctcccattgcactgtcccagagcggcgtagtggcagctggggttagtgctatctgtcatgaaagggcattctactcggttggcagagaacactcacacacggggaagctgagccatcagtgcaggagttaattcccgtttgcaataatactaaggatgtcgcattcatatatactcaatgagcactaaaggaatcataggaatatgctctcacaggagataatgtagccacagtagataaaggaggatgtcctggaagaaggggaaccttttttaagccaagggagaaaaccactgaaaagtaaatctttgcatgtagctgtgcagctctgcagatctaaaatctgtgctttttaaaagtatactctgtggagtagcagtccacatcaaaaggtcacagtttaaaagttttgtattgtgcttgggttatcccttaagacgttagttatatcatcacaaaagaacaagagtaaactgtaatttactatttttggagtatttttttgttgttaggcatttgaaggatgaggtgcacagtgcccaagagtatgtcacagcggcaatttccactttatgcagaattaatactcaattacttatctgcttacctggaccttgagtgaataatagattcctaataaagggtttttgagcaaatggacaaattggatgcatttatgttatagcagccacaacagcaaaagaaaatcaaacacttacaaaacagaagtcaatcaagttttaactagaggagacaccaaagtatcatacagtggaggaaaaattcaaatgttctgcgccaagctcctatcatgccaattgtacatgtttgtgcgtatgtagggtagctagggttggatgtgtaatcatccctaaaattcatttggtgaagaaaaatacattttatttgaaatcattgtctatttttattcctgccaatattttgtataacatagaagtctgccccagagtgtaaataaataatgaggaaggtcacagatctaaatatactatcttggttcaataataaaaagagaattttttcctcgt

SEQ ID NO: 122 - DNA, 2413 bp, Homo sapiens
ttccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtggagccccagagtgtgccacttctggccaggtccccaagcaccaacaggaaatacccacccctgcccgtggacaagctggaagaggaaattaaccggagaatggcagacgacaataagctcttcagggaggaattcaacgtttttttgtggaacttgacaagctgattctaaaatttatatggaggtgaaaagattcaagaatagccaagacattcctgaagaagaagaacaaggctccccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtgcctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattg

SEQ ID NO: 123 - DNA, 2576 bp, Homo sapiens
ttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtcttttttttttttttttttctccatgtgcctccctgtccccaaatctctgcaccaaagctcattgcaggcaatgttggaaaagaactgcatttgaacgaaagagaaaacggcgcctgtggttttgcttcaggccactttgaggggttgcaggtcagtcaacatgactgatccttgacctggctctgctgggctggactgcctgggccagtgataatgctgccattggccagagacagggcagagcccgtccctgtctgaacaagagtcccgcattagcaatgagaagaagcgtggcgggagaggagccaccactgccggggactggagtttgttggatgtgaggggaatgcccactggggccagggtgggcaaaggaggttggtgccaatgtggtgctggaagtagacccctcctgggtctggaacattctctgccccaggctctttccacctggggatgttgtgacaacatccagctgtggtgtctgggctatttgtgtggtgacaagacagacctggtcagggggtgggtggcaaacacctcacctggctgggcagaggccaccttgctgtttggcccaaggccaggtgaggcccctccctttccaccattgccctggccccgtggccattcattcttggggtttgtctgagtcttccacagagagcagcaaagagatatgggagttgggtgatcagtgtatttactttgcagatttttctggaaataacctctagctgctgctatttgcaaggctgggattggcctccctgtcttttccaacaatcaggaccccatcctgtctgttcctgttcttctcccagcctctgccctccttctgtctcctgggtggtctcccgcttcgctcctggcctttgcatgttccatctcttctctttctcccctcttcgccaccctagattatctctgtgtccctctacctaattctcttaccagttctttcctttctgcttagagccggagggagggaagctggaatctgttatggtgtattagggggaggagcctttctgttatttccccccagcttccatcacccttcccttaatgccaggagcgccgaggtttggaactgaggctaaaccgaagggctttctcctgcttctgtcaccctgtgctgtctcccggcatctcctcactatctgggtccaggcccgggtcctccctgcagactccctcccctccagcccacaaggactccagcctgctggctggtgagagctggatgagcagtaagaagttaacgccaggtcagcctcgggccccagggttccctgggcacaggctgacactaggagctgctctccttggccggggacagctccagcagctcaggctccagccctccagtgagccgcctctcctggagagtagcaaagaatggagaaaggcctggcttgagaggaaatggagaaaacattgcctggtagctgcagattcaaacccaccacacacaccacggggctagagtgactcacctgggctcacaccaacttctggccaatgcagggaccatgctctgcagacagcagtcctctagcatggccccagcattcagccagtcggtcacctgtgggccatccccatgtgtgaggaagcaggagtcagccaccaagtgtctccacatcggagcttgcgggtcagacctgtgggccaggggatgggagcagggctgagggtaggggctgaatgtgtggctctgtccctgtgttgccttccacagaggagcaaggcctcaggctgaggaaggaggggcacgctggaacagcctagtctcctccccgtggattcccccaaacccataacattcttccataggggctgagaacgcagtgccccgtccctgacagggatgaaaagtgaacccctcaggtcaggagaggcagagttgaggttctgccacttcctgtccctggggagccactcaagttaccagggctaccggctgaaataaatcttttccgggtagggtcaagggcagtgtgttgccaaggcaactgatgtaggccagttgcgtgactccaggtttgtcctggtactcagtgggtccaatcacctggcattgatcacctggcattgatcagcacccaccccacccctgaggcttgcccagcccccaggccctcagatccctgctcttcctgcctttcctgcccatgtgtcacccagcacccaaggttcagtgacacagggtggtttggagctggtcactgtcatagcagctgtgatttcacaaggaagggtgctgcagggggacctggttgatggggagtgggaaggggaaggaataaagagatcttcctcaggt

SEQ ID NO: 124 - DNA, 2525 bp, Homo sapiens
gcattgctgtgtgtctgccaccgctgcctggcactcatggggccgtgtgtgtgtgtatgtgtgtgtgcgcgcatgtacatgtacgcataagcgtgtgctgtatgtgagcctcctgggcatgggtgggggttggcattgcggttgccaatctagtgtacaaccagaaggacagagggatggagtggaagaaggaggggagaggcttggggtctgggaggggagaagagggtgcatgagttgcttcatgctgcctgcttacaggcattggcattgtagctgccacccttgtgcccacggagatgggaggaggcgagtggagggcgcagcggcaggagtcctgtgctctgggaggaaggctttgtacatgggagctgttgggcatcacatctgtcaggccggtgcccagaactgggacaatggagactgggggatccaggaagcagggaggaggggcagaatgtgtttctgatgttgctgtccctctagaagctcagctctgaaaaatggttggagtatgaggtgattagtgcccttccagcttgaggaagtaaagtggtggagagagtagccagggaagtgccaagaaacagtctacgagccagggaggagggagtgtgccaccgtacccagggagaacttgttggggctggcaatctggccctttgtcagagtattgaaggagacagcaagaggaccagatgtgaggtgggtgggtgctggcactgcccatggcacctggcacaggctctggcattgtgtggaacaggggagggtgacagtgcctcttgccaatctggttgagagggctattgtgccaggagtgagaaggaaggaggtgaaacatttcgggaggtggggtgtttgggagaccagatttttttctgccaggtcctccttccccttccctcttaggcatggggagtggagcaacagacggagagtggcatgaagacacaaaggaggaagcacaccattgccaagaccccaaggaagaaggatggaaagcgctggcagtcctgcctggcccccagccagttccctgctgaagatggccagatccccttgtctggcctcccagctctggcaccagattgggatggtggcctgtccccagtgagaaggaggtggcaaggaggctgtctcttgcactctgcaagatgcttaagtggagacggggtttcaccgtgttgtccgggatggtctctatctcctgactacctgacccgcccaccttggcctgggattacaggcgtgagccactgcgcccggctggaaggaaaacattctgagtgaccgtgtatgtaaataagtctttctggttattttattctgtgaacctgtgtgatgtaatgactgcatttaaatagtattacaacaaaaactaattgtaataatagtaaatagctaacatctttaaatgtttgccatgggccaggcaccgtgctaggccctcggcaagtatcacatcacctaatcctccacttcaatctgatgcaatagatgtagctattcattcctattttacaaacatggagactgatttagatgggttaagtaatttttaagatctcctgcttaaaaagaagtagagttgagattggaactcaggtagcctgatgtcagtacctctgctcttgggttaatttgtaagcttctgaactctggctggtatgcattttgaatgaggtcttttgagtctgattgtattactctgtgtgtcaccttgagcatatgtgctatcatgttccgcctgaaggtgctagatggctgtcttccatttggtttgtttcttagtataagatggaccagaagaggagcactgctttgcgcaactccagggtgcgtcattcacactgcagtccatgcaggggcactggccatgccctgtgtgaaggaagggaaggagcgggagggggggagtgggaacaggagggaagggatagataatggcgggtagtgttctttgaatgatatgtgtacccatttgtgacaacatctcttaaagttgaaggtctacacatgtgtatccatattagcatatgaacttcatcagacaagcactctccctccaacagagggagaccctgtctcaaaaaaacaaaaaaaatagcctttagagtcagacagacctggaatcaaattctagttctgtttcttaatatgtaaatgacctcaggtaagttgcgtaaagtctcaatttagtctcttcatatagagaatggggcaggccgggcacgcgcctataattccagcactttgggaggccgaggtgggtggatcattgggggtcaggagcttgagaccggcctggccaacacggtgggaccctgtctctactaaaaatacaaaaaaaatgagccgggcgtggtggcatgcgcctgtagtcccagctgctcgggaggctgaggcggaggagtcgcttgagcccgggaagcagaggttgtagtgagccgagattgcaccactgcactccagcctgggtgacagagtgagaccctgtctaaaaacaaacacatcagaaacag

SEQ ID NO: 125 - DNA, 1875 bp, Homo sapiens
aaaaaaaaaatatatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacacagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagtttttcacttgctggctcttcttgctgtaaatggtgactaagaggttgggacagaaatcttgacaactagtggaaaacttggataatcttcaaggaccatggagccttctgtttccttctgtttgcagaaaagcaacactgcctgggttgtgatcctttacaagtgactacttcagacacaattggccacctctttgtatcactggatgactgatgtatgatttatgtgctgctgcccttagagggaagaaaaatgccatgttaaatcctgttttcttaaataaaaatgttgacaataaccagccttcccaagtgggagacaaaccatt

SEQ ID NO: 126 - DNA, 1727 bp, Homo sapiens
aaccggcatcgccgccgccggagccgcagcgagtcctcagagcctggctgctggcggccgggagcgccgggacggggcgcgaagccggaggctccgggacgtggatacagatgaaaagaagcaaggaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgtggccagcttgcagctgtacatctctccaagagccggactgattatcagccaacacaggcaggcagactaatgagaccatcagtgaaatacttgtcacatcctagagttcagtcaggttgtgacaaggaagctctgctgacaggtggtggctctgaaaacagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaaattgaagaatctaagaaggaaacaacgaaggcgtgaaagatggctacagaagcagggtaaatactcaggagtgggattgctggatcatatggtaagtatatatttacttatatgagaaattgtcaaattgttttccagaatggctgtaccattttgcattccaagcagcaaagacttccattttctgtgcgtccttgaaagcaagcactggtattctcagtgttttaaaattttagtcattcaaatacatagacagttgtatcacatcatgactttaatttgcttttccttaaggatgctgaacatatgtgcttattttacatttgtatatattctttagttaagtgtcttcaaatcttttgggctggtgtggcagcttatgtctgtaatcccagcacttttgagaggccaaggcaggaggattgcttgagttcaggagttcaagaccggcctgggcagcatggcgaagccttatctctac

SEQ ID NO: 127 - DNA, 2530 bp, Homo sapiens
agaaggaggctctggcaaagcgactgctggcccctgaactgtttggggaagtgcctgcctggccccaggagctgctgtgggcagtgctgcccctgctcccccacctccctctggagaactttttgcagctcagccctcaccaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccttaggcgagtcctggtcggggcttgttcctgcctggcccctgaactgtcacgcctctcagcctgccagaccgcagcactgctgcagacctttcgggtatgagagtggcaaggaggatgagataatcagggataccggctctttctggttgggaggaaggcatcttccctgaggccagggaaggcctttcatacctccccacttacacacacacacagacacacacacacacacacacacacacacacacacacaaccaattctcatgcaggttaaagatggtgttaaaaatatgggtacaacaggtgctggtccagctgtgtgtatccctggtcaggtaagtgtgagatctcccaactgagctcctctccccattctggggcagtttcatatggctggtgctacctcccacactaccctgcagtggccctgagagttctggttagctctgtgcccattagcagccctccccagtgccagatgcaggacagcatgatccactcacattgtcctagactaatgtcaaagctggaagggcctgagaaatcttccaggccacccaccctgctttcagatgaaaagaccaaggctgggagaagctaagggactttgtttgcctggtgcctaactagcagcaacacttgaccacagcagcctgcagtgtgaggctcttaggcgtttattgctacagtggcaaatgccattccacttctgtcctagctttggtccctttccacccccatggttccttttctctgagtgctaagtacagactctctcacctatcactacactgctatacccatcaccgccagcagcctattcccaccacctggccagactgcctgcttcccctgctcccattaaagctgctacaactggattccttggctcttctggcaaatcgaagacgctactgggagctgccctggtctgagcagcaggcacagtttctctggaggaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccttgtggggtcccccccggggatttcgtcctgagcagatcctgcagctcggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagtttagccaagcagctctcttcctcggcaccctgcatctgcagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacag

SEQ ID NO: 128 - DNA, 1480 bp, Homo sapiens
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggcggcagccgcggctaagttcacgggcctgtccaaggaggagctgctgaaggtggcaggcagccccggctgggtacgcacccgctgggcactgctgctgctcttctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgcctttaaataaaagtcacccctgcatggtg

SEQ ID NO: 129 - DNA, 1786 bp, Homo sapiens
ggtttgagtgggagggagaggcagagagcccaagttctttgggagcccaaggtgaggtgaggcaaagagagagaagctggtgctctgccaacacaaccgggcagcttcccagaatgggccagaggcgtgcagaggggctgtggggcagaggtgcctgaagaaaggggctagacagtcagtcccagccagagaagggcatggagaagaggaaggggagcccctctctcaacctcatagattctagattagctcctctggcccagcagggctacagaaatctgaggatccctgccagccaatcctcttctccccagcaagagtttccctggtgccctccagtgggcaaaggacaggacaggatcaccctctgccacccccatcctccaccttcatcccaatctcatgggattgctacaacgcaacagagggcgaaggagtcaggctctcatactccattacaaatgggaagactcagcccgggcatggtggctcacgcctgtaatcccagaactttgggaggccgaggcaggtggatcacttcaagtcaggagtttgagaccagcctggccaacgtggtgaaaccctgttgctactaaaaatgcaaaaattagctgggcatggtggtgcgtgcctgtaatcccagctattcgcaaggctggggcaggattgtttgaacctgggaggcagaggttgcagtgaggtgagatcacgccactgcactccagtgcactccagcctgggcaacagagtgagactccatctcaataagaaaaacaaaaagcaaaaaaacaaacaaacaaacaaacaaacaaaaacaaatgggaagactgagaactagagagggaatgtggctcccagaggtggcccagagccagggcagagccctgagaataaggacacccccatgagctggggccacaggagtaggaccctggctcctatatcccaactctgtctccagcccagggctccccgcctgggtgtcccccagcttgatcaaacccactattctcacaaccaaacatctcatcttctacccaaactggctccatctccagtctgtcagtttccatgactgaaaccccccactcaagttgatgcttgagcccaaaccttggcacctcccaatgcctccttcccccttccccttgtgccacctgtcaccacgtctatagatcctgactcctgaataactgtgactctgcacacctctttccctacaacatctgccttaatccaacagtttgcctcggacgttccccacaccaaacgtgcttcccactctgtattcagggtgatccttgttaaagcaatatgatcctttcactcccctgtttgaaaccacctctccccacgccaacctaatctgatccccaaaaccttccacctacatctcccattgccccctacgccatcatattccagccacactggattacattccattccctgaacacaacggtatgtcaggtcagcctcttattggctcttgaaagctgaattgtggccgggcgcggtggctcatgcctgtaatcccagcactttgggaggcggaggcgggcggatcacaaggtcaggagatggagaccatcctggctaacacggtgaaaccccatctctattaaaaatgcaaaaaattagccgggcgtggtggcgggcgcctgaagtcccagttacttgggaggctgaggcaggagaatggcgtgaacctgggaggcggagcttgcagtgagccaagatcgcgccactgcactccagcctgggcaacagagcgagatttcgtctc

SEQ ID NO: 130 - DNA, 2533 bp, Homo sapiens
ggctcttgcattcagaagaaaagagaatgagttttggtggaccactagcctttgctgggataccagcatcttcatagctgtcacctaccctcagatcctctcgtctttcgttattcagcctaggttgcatgatctaacacgataatcactcccttaacttccttgctgttctgcctccttcatgcaaatttggaaaactctcaactctgtacatgtctgtctctgaacagctgaaaatagctgcagaaaaaccatgtctattcttaaattcatgaccacagacttaaaatgggcactcaagatcgctgagcaatcctttcaacattgtaagactttccttatttgtttactttccaactctctgaaattgctgttttgcacctttgcctctcacttcaaaacccctccttcagtaggccaggcttggtggctcagacctataatctcagtgctttgggaggccaaggtgggaggattgcttgaacccaggctggagtgtggtggcatgatcatggctcactgtagacctcctgggctcaaacgatcctcccgtctcagcctcctgagtggttgggaccacaggtacatgtcaccatgcctggctaattgtttttaattttttgtagaaacagggccttcctatgttgtccaggctggtctcaaactcctaggttcaagcgattctcctaccttggccttccaaagtgctgagattacaagcatgagccactgcgcctggccaataaatgctttaagctgctgaattttggaggtaatttgttgtgtagcaatatatagccaacacatacataaataaaggtgtctttttgcaatatggcatcctctgaaaaatgcagtattcctattttgtagataaggaaactgaccttagagagatcaagcaatttgctaaaagtaacattactggttaatgtcaagtaaactttaacctggcctatgtcagaattcatttaaatctctgaatttatttaggtctaaactggttattttactgatttctaaaaatattaatagggaaatttgatatttttgtgtctttgtatccatcttcttccttgtaggtggatggcttagcaaagtattttttattaaaggttgacaatatatcccacataatttctctttctcctgtttttttctttaaatttattttgttttgttttttatttttttgagacagagtctcggtttgttgcccaggctggagtgtagtggtgagatctcggctcttgcaaccgccgcctcccggacttaggcggttctcatgccccagtctcccaggtggctgggattgcaggcgtgtgccaccactcccagctaatttttatatttttagtggatactgggttttgccgtgctggccaggctggtctccgactcctggcctcaagtgatccgcctgccttggcctcccaaagtgctgggattacaggtgtgaccctggcctctttctccttcttaacactagtgtgttagttgacttgtgtgtttattcatatgttatacatttattgaggacctgctaagggccagggactaggaatagaagaatgtgtaaatcacagctctaacctttgcctttctagtctggtaatgtctctgaatgccgatctctctctctcttagaaagaggtgccttgtcctctctctcaactgtcccaccatcagtaagggaaccaggaaaccagtctttgagtatggagttaacaagaaagctgagtgttgggcggcttttttgtggaagctcactgcttatccatgtaatgtttcattaattctttgatgctgaagtttcacctcctgcagggagcatttgcagcaccccaggcgagttgtcagcagttgctgcctggcagtagcacacattaactctagtgagcagaagtggagctcgaaggctccccacactgctgcaccttgagctgctcttcctggcccagcctgttctgcttcctgggaccccagatctggtctccaagtactgtttctcttctaagtgtagtcattaacttcccagagtgagaagaagagactaaaaaaaaagagagacagactgtctcttagttttaattaattgttgaaagaatagagaggggccatatttctactgaaagaaaggagaagttggggaatgggaatattctgaaccggaatgaaaaagtgaatgaaaggtaatctttagattcagtctctttgccctagtctttaaaagtttctgttgggggttatttgccctagtctttaaaagtttctgttgggggttacaaagtttgaaatctgtcttaaggagggatgtattactcaaaataaattgcctctatcattcagtgtgatatgatggacttggaaggggcaggattagaggaggtgagggataaaaatctacatattgtgtacagtgtatactactccagtgatagatgcactaaaatctcagccttcaccacagttcatgcatgtaaccaaaaccactgctaccccaaaagctgctgaaataaaaagcaacaacaac

SEQ ID NO: 131 - DNA, 2784 bp, Homo sapiens
gattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaatttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattc

SEQ ID NO: 132 - DNA, 2813 bp, Homo sapiens
cgcaggaatcgcatgcaatgtttaacgagaggcagaatgtgggcaccaggtgtgaagcagtccccggctgtggacgggagactccaggctgcgccaggcagggcgccttcccctggaccttgaagggcacccgatgtcctggggccgtgaggggcggggtgcttatccatgtgacaggattcttccagtagcaacagggagggcccagcaaaacccgcagtttgtttcgggccacgttccaacaagtgactcggcggcgtctcccacctgcacactcagtcaggaggctgcagtctcccgtccagccccacagcctgagggattcctgttggttacccagaactacctgccacaggtgccagggcaagagatgtcactcaattttccagcccccagtcctgtagacatcctgggtgtgcggcacacatcggctcactcacactgaccctctgagccggtgagaactccacaagaagagggccagcgcctcacaagatcaaggcggaacaacgcgtttgtgggatgatgaagacctcataacagacgtgccagtgggttgattactgtgaaattctcaactgtggtttctgtaacttaaaaaaaaaaatttccactttgggaggccgaggcgggcagatcacgaggtcagaagatcgagaccatcctggctaacacagtgaaaccccgtctctactaaaaatacaaaaaattagccgagcgtggtggctggtgcctgtagtcccagctatctgggaggctgaggtaggagaatggcgtgaacccaggaggaggagcttgcagtgagccgagatcgcaccactgcactccagcctgggcgacagagcgagactctgtctcaaaaaaaaaaaaaaaaaaaaaaaaaagtccagaccatgatattctttttagggatgttctttgcagcagttcccctgctaaaatgaattagagcaaagcaaattgcagttagcagtgtgcattcccgacctgtgggccctgatggacaccagtgcctctgccacctgggccagtcgcgttaagtgctgggatggtgggccagtgtccaagcagagcttgtgaagaatctgcacacgcccctttttgcatgtgctcacccaaagtgaaatcatctctgggccttccctaagatctccttgagtcaggaacctgcaagggcacaggccgcctggcaggccattttgatacatggtctcccactgttctgagcaggtggcagctgcgaatctattctttaacaatttaatagatgcctcctcggaaaaagctattgacctgagaccagtggagactggaggacgagatggggtcagaagaaaggactgcatacggccagaggcaccgtggagttttggccagcacagagccggggcgttgattctgatgaggtctgggcaggaaccaaagagagcttcatagacaaggcggcatctgagatgagcctggaaaacgcagacaggagaggaatcggcggggagggggaggggtcctccgggaggagctccgctgccagcgtacccaggcgtgacggccgctgcgttctccactgattagatcacgctcagacacactacctcctcccagtacaattaatcaagaaatattaagctataatttgaataatctgtgtgaaaaggtctttcgatgtggaatgagagacacctttgaggaaatacattacgatacaggctattaacctttaccaagctaattaaagccagccagggttaaagctgtcaacataactttgcataaatttcctcaagatttctacttaaggggacttggggatttctttttctcttttaatttttaattttgaaaatgaggccctgtaaacactgcttatatttggccactaagtggcctcctaaatggctgatttctttttaaagtatgaagattgtttgctgtggcattattaattacacacagatttgtaccactttcctccactagaattaaggaaatttgtaaaaccaactcgtggtcagactccagcaaatgacccatcgttttccaccagtgtctctgtttctatgtaaaattatagattaaacgccaagtcctctgcctccacctgtccagggtaagtaaccacctccagaagtgagaagctgggagtggctctgagaggggctgactcaagtattctcctaataaataggggcgggcgaagcatcagggcgaatcccacgtgaggcagaaaagtgagctgaactatcctggagtgttttgttgcattccatatctccctcaaaactcactgactctggaagcagtggttttgaagtcttaattgaaacaaagttgagatttttaagaaaattaacaatttctaatattttcaattgtctggtgtttccagcttttattggctcttgtcgaaatcaaattggaagatcttcagtcccagctgcacccaacgtggaaaagtattccaggtccatccccaaggaaccaacaccgatgacatggactcaggaatcttataacctacgtggactctttccatccgtacattgtcgtgcacatgccactcatcacctggcgtgcccagatcctcgcagggcaacaccctgtgataattccaggtgattctctacatctgcagcttgaggttagcctcatatcacattacattctcactagaaacaaaacaaaaatgaaatacttaaaacatctaccagaacagaattaggactggaaagcagcggtcttagctgacaaacaagttgtgccatctgagactcatgggagtaaatctcctctttcatagtaaaatctcattacag

SEQ ID NO: 133 - DNA, 2050 bp, Homo sapiens
gtatgcattattcatcactgttctaatcaaacaatcaaaatcgtttactttcaccgggaatatttagcaagatcaaagacactctggctggaacggctcttgttttaccgctgacagatagcctttgatttttattttttgcagtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattgtacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttt

SEQ ID NO: 134 - DNA, 1940 bp, Homo sapiens
agtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacagtaagtacagttgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacaggcttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggcatttatctgccaagaatatacttcattcactaataatagactggtgctgtaactcaagcatcaattcagctcttcttttggaatgaaagtatagccaaaacataaaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 135 - DNA, 2752 bp, Homo sapiens
attcctggactccgcccctgctcccctccaagggcgacagttccgccccccggaccagagcagagggtgttgtgagcataaaacactggaggcggcactgccccggacccggctccgcgcaggcaggggcactgtggagggccatgcagtgcctggggatccggagccggagccgctccagggagctctacctgcaggagcggagccttaaggtggcggcgctcaatggacggaggctgggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagatt

SEQ ID NO: 136 - DNA, 2207 bp, Homo sapiens
tccggcgccccgcgccgcctccgctgcgggtcgggagcgcgcgtctccgccgcacctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgtttattgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgc

SEQ ID NO: 137 - DNA, 2255 bp, Homo sapiens
tttgattctgtaggtctagtatgggatcaaaaattctgcatgtttaatgtaaactctcaggtgatgctgatgctggctgttcatggaccacattttgaatagcaatggtctagactgcatatgggaattatattatgtcagtttccatgctgctgataaagatatactggacaagatatactgggcaagactgggcaatttacaaaagaaagaggtttacagttccacatggctggggaggcctcacagtcatggcggaaggcaaggaggagcacgtcacatcttacatggatggcagcgggcaaagcaagagcttgtggagggaaactcccccttaagaaaccatcagctctcatgaggcttattcactatcaagaataaggatgggaaagacctgctcccatgattcagttgcgtcccaacgggtaccctcccatgacatgtgggaattgtgggagctacaactcaagatgggatttgggtagggacacagccaaaccatatcaggaatgaagccaaaagtcttcataggtgaggagaatatgagcattggagatcctgttaggttaaagagtacagaataggtgagatgagagttgaataaatagaagacttgtggactaagactaaaaataagatttatgtcccttcagctcaggagtttgagaccagcccaggcaacatgctgaaaccccatctctacaaaaaattaatttagcaggtcatggtggtgtgcacctgtagtcccagctattccagaggctgaggtgggaggatcacttgagcccaggaggcagaggttgcattgagctgagatcatgccactgcactccagcctgggtgacggagtgagaccctgtctcaaaaaaaattttatgaagttgaacaattctgagtgatgacaagcccagactctagtcctgggtgtggttgactaaaatggaatggcatttaaagtcctgtgagaatcatagatggacggagaagtactaagttcttcagtgaatatggaggcacagattgggaagctgagtataggagacagtactactgaagggccgtgatgcctgttacggacttttacatgagaacataaatagttgtctgaaaagtggctcctggcccagagaatgcctgttcctgttgccagccctatggcatatagagtcctgaaagaataagcagcgtgcactctctcgtggggaaagtgaacacttgagaggttgaatgtgcttctcaccaactcccttggggacatttaaagatgtaaggggtaatttttggcacaacctaaaatactgttctcttcctgttcagggcttacctttttttaaacagggtattcagagttgttaatagctagggttgttaagaattatcctcaggctcctaaagaaactggcaagttgaattcagttatttggtatctgagccaggtaactgcatcaagtggcctgtggcttacagcttttctaccaggggaacaatggtgaatttataataaaaacagaagtgtctcaggctgagaagaggtatgaagaaaagagtagactcatgaatgatttctgcactctcaaagtaatggttaaagaccctttgcatagtgtaaacttgtcttgcccatgacatctgtgtaaatggaactagaactaacttttggattctactcatttttaaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccct

SEQ ID NO: 138 - DNA, 3049 bp, Homo sapiens
aaggagctagacggcggtcggattccagggtctgagagagagccaagatgaatatggccttccaagaagacatgctgacaagaaaagactcagagtgcccaggagcttccccttcctaccaaccctgcagcctggaaccctagccatacctctccctgactgtggacagtacagcctttgagctgagccaagctgctcccctggcgatttccataagagtaccacttatcagcaccttggacagcatacaaatgattctgcatctccagaaattgtcacagccaccccaaccttcagctaccactaccctgattcatcagcatcaataccaaggcaacatcctccaccagaaaaagattacaactcaagcacattcacctggggatctggcaagatggctgaatagcaacagctccagtctgcagctcccagtgagaccaacacagaaggaagaactggtccttcagccaagggcagcactgagccccaagtggccccagatgagtgcaaaggactaccagttttgatcagcgactggttgaattcgtggatgcaaaacctgtggatacagagggacagaggcctactgtacatggcacatgggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggccctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttg

SEQ ID NO: 139 - DNA, 2575 bp, Homo sapiens
gaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcaggcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcatgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaagacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagaatttgtcacccaatattaggactgaaattcagactcggtaacttgtctgagatctgcaagactgaacatcccctactgtatagtttcctggcattttcatttagcctttcctaattatttttgtctatagtctgttgtaggtaactctaattgagcccgaaaccagaataaaaactcttacattggaaacattt

SEQ ID NO: 140 - DNA, 2252 bp, Homo sapiens
actctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcgtgagtccgggagtctgggataccggcggcagaggaaggacaggcaggagtctcggcctctcggggagcgacgtgccgggaaagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccggatcaagaggttgacacagatggcggaagaaaatctgaagaaagcggatgaccagctacaatgagtaatctaatgtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcactcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaaagaatgctaatgactggtttgctgttaataaatacgtgggtaaatctctgtttggggctctcaactctgagggctgtgagacccctgatttcccacttgacacctct

SEQ ID NO: 141 - DNA, 2055 bp, Homo sapiens
agaagcagcttccctggagaacagcaagctcgtcagctgccacaacagctatgccaccaccctagcatggcctgggggctgccttgccatcagaacactgctggtgccaacccacacctcttcctggggtgctactcaacctccagcctacaggggctggagtatgggggccagcgtggagatgcccatgggaaacccggggtcctgcacggtgagcttgagcctcacgaccacacttcccgcctggagagacacgatctgcattctcagcttcccacttcggtacaagtcagacaccactggtgggaaggagctctcgacctagccaagaagaggcaacagcagacatccatcaacgtcttcacgaccattaagcagggttccaggtgtgaccgatggatggtgcttggagccatttctctcctctacaatcaagaggaggcacctgacgaccgacctctcagagcacgcagagaagtccgttcacagcaccttagctgggctttccctgggacggccgggcctggcctggtgtgtgctggggactcacagtgaccactgcaatcaagctcccagttgtggagcatcagatggacaatcccctctgagtgtcctgaaaactggtgcgaaggtcatttgtgtgagcgtgtgagaaagactgattgattgatagatggagaggccccaccaaggaacaatgcctatggctatttggagctgtcccccctcttactaggctgtatcccacacaaaacacgcacacagagccaggtgcttagggctacccatgcccaagcaagggagataccagcctggttccctgcctttgtgccaacccatacttgcacacacaagtgagttaacatttcaaaagggagggaattctctgaaaacattgaaaaccagattcctcctccaggcaaatgttgggaagcaacactctgtgggtctctggcatttctacacatcttgcaagtagacgcactaactgcccttttgttccagaatatctttccaaggatgtttgcatagtgaacagccttgggagggagagatattggctccctccagagcaaagggcaggtttgttactgtctgatgtaacagataatgtctccttctggagccagtgcttgcacccattataaaagattcaggttccctagagttggggttcctcagctcaggtgcagacccactttgtgtgcttcatgcccctggtcccctctgcatcacctctgcgggactcgggtgcaggaaggggaaccggcacagcagcacacgcatgctgcctgctgtgctggagtaatacagtcttccgtctctggcccaggagtctcgtgtcttctgccagcatccatgaaactgtggcagactcacttgttagtttgcagggagggtaaaacctcagactttatgtgattcttggcagtttaggaagtcacttctccctccaatgcaccatctgtggatagatggtgcttcccactggcttgcttctccctggctgtctgctgatgtctccctttagtcacgagggaggaatggatgccatgattgttggtaaatgcttcactaatgaagctaccccatagctggaagccagggccctcagacagaaggttccacagaaaatccaacagtaggagtaagtggtgtacaccatttgaataaaggcacatatcttaaagatggattggcccagtatctggattaagtaccccataaaagcagggggaaagcttttgactaatcactgtgcgatttgggtttggcctcccctgaagctgcagtaacatgtatttttgccacaatcccagaggaagagctgggcaggaattaacggcttgtgtttgatgtcctcactcagaacacccaagaaaagatttctgtctgcattgtggctttacctcgtgaagcagttgtctagaaaagtcctggtactccacactgctgcggttgagtaacttctccgtcaggttgtggtttacaatctttattgtgacttcaaatacctgggcatctgagacagacagtgaaacaaattagcctgtg

SEQ ID NO: 142 - DNA, 2157 bp, Homo sapiens
tatttaatgattttggggggtatcttaattccctcttcttcttcttccgtttttttttttttttttgagacagggtctccctctgtcgcccaggctggagtgtcgtggcgtgatcttggctcactgcacttctgcctcctgggttcaagcgatccttccgcctcagcctcccgagtggctgggactacaggaacgcaccaccacacccggctaatttttggattttttgtaattttggtacagatggggtttcaccatattgcccaggctggtctcaaactcctgagctcaagtggtccgcaagcctcagcctcccaaagtgctgggattgtaggtttgagccaccgtgcagttcccttcttatagaatatccttcaatacatcctttcaccactaatgtgaagccatatctagccagtccccaaatgttactgattgttttcctatgatgtatccccccagttgttccttctgctcccattatactgtgatctcccagactcatgcctgaacgtatcagttagctttttctgggtaataacacaccaccagaaaacacagtggcttgaaacaataaccatttatttatcctgtgagtctgtggtcgctagtttggggccgggctcagaagggcagttcttctagtcttgcctgagcaatttgttcatctgtggccagctgggacagggtctcaccatccagtagactagattggactcatttacatgggggcagaacaggtccaagtgtagcaagagggcaagcccagtgcacaggtgctttgcagacctctgctagatcacctttgcgaacattccattatctagaacaagtcacacagccaacccaggtccagcaggtggaggaataaataaactctgcctctttttttttttagacagagcctcactctgtcgcccaggctggagtgcagtggtgcgatcttggcttactgcaacctctgcctcccgagttcaagcagttcttctgcatcggtctcccgagtggctgggattgcaggcacccgccaccacgccctgctaatgttttgtatctttagtggagacgggatttctccgtgctggccattctggttcaggtgatccgcccactccgcctcccagagtgctgggattgcaggcgtgagccaccgcacccggccaactctgcctcttaatgggaggatctgccttgtcacattgtagggtcatgaacggagggagaataactctgcccatttttacaatttgcttcattatcatatttcccttccttgcaagcttttctgactatggacttgctgctccaattcatcccacttcgtgctaccacattcattttccttacacactgccttcatattacatcctggttcacaaacccgcagaggtcgcctcttttcctccctcatatgctgtaaactcttatgcccagctttcaaaggtctctttaagttagcctgagctaaaagcagaggctgtgctgtacaggaaaaaaggactagcatagtcaggggaggctgtcaacaaactttattacctctctgggcttctatttctcctataaaatgagaggttgggctaaatccatgagattcttttcagatttatttatttatttatttatttatttatttctcgagacagagtcttgctctgtcacccaggctggagtgcagtggtgtgatctcagctcactgcaacctctgcctcctgggttcaagcaattctcctgcctcagcctcctgagtagctgggattacaggtgcccgccaccacacccggctaatttttgtatttttagtagagatggggttttaccatgttggccaagctggtctcgaactcctgacctcgtgatccgcccacctcggcctccccaagtgctgggattacaggcatcagccaccatgcccggcccatgccagcctctcttctaagcattttgtatttatcatcttatttaatcctcatgacaaccttatgaggtaggcacatactattattattcccatttaacagatggggaaattgaggcaaggagaagctaagtaacttactcaagatcacagaactctaagtggtagaacaagaaggcaaacacagcaggcagcctgactcggtgtcctcaaaatctaactacattgcctctctgagg

SEQ ID NO: 143 - DNA, 2295 bp, Homo sapiens
aacaagatggcggcgctgcgggacggctagcggccctgcgtgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgataagctgctcctcaaaccacacctttggggattttgaagggagtggggatacacagcctccccagacacctcccattctgaggggaagccgctgcactccctgggggaccccagtctgatgccctccaggaggataagtctgaagccgggctgggaagggagcggagaggcccgaaacagagcagcaggcagcgccctctgctggcaccctggagacagcctcggctgcggggcccctgccttctagtcctccccagctttcaggacaccttgacaacctggggtccctgcagaagtggcccggctgtcccccaagtctcctgaagctatctgggtagggtgggaggcagtgctgtgagccacaaatgcaaagcagaggggacagatgttgggactcaaagacatgaggtagagctggccccatgggtaggtgccaccaccagagcccatgaggcttcgtgttctagaaggtggtgggttagtgccgcactgagggcgtgtccgggagggagcatgtgtcaccagggctcaggaaacagcatgagtcatgacgcgggggtgtttaaggcattcgtgctacagcggggacctcggagctatgccttgataaggcaagtgaggttacatgtacgatgatgcggtttgtgctgcagactggaaaaaagcaggggctttgtcctctcctgaccccctcacactctgccttcacggtaggctcctgagaggggggtctccaaggagggtgtcagtactgcagcttcagctggcgtggatggggtgcttacaggagcagcagggctgagggagatgacagcagtacgaaccgtggctctcctgaggcctgggtttcctcatatgtaaaatgggggttgcattagaccatacccttggcctgtgtttaggcaaatagggatgaaagtggggccaagggctgaagagctgggtccgctgccgtcgttgcccttctttcttgccaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctctcccggtcccggccccagtcccggtcccggtcccggccccagtccctgtcccggacccagtcccagcccccaataaagcacccgccccctc

SEQ ID NO: 144 - DNA, 2112 bp, Homo sapiens
atccagagacggattgctgagatgattcctgctttccggctccccgacacccgctgttctttagatccgctcagcggcgctttttcctgtgccacgtgcccagatctgagcgaggcttgggaagacgcgaacgggctgtaaaatctgtccccagaactggagagtaagaatgcgcggtgtggggctgagctgagtccagggagtgcgagaatttagcagtcgtgctgtgcctgggcatttcagactgtgccacagccgggcctgcctgttccgcaatgtggctgaggaagggagccaaaaacgctgctgcagggctggctgtgggcagtggcaggaagcaaacagaggctctctggcgacttctctcccctggaggccctcctccctctacttctagccccactgctgtgggacagttgcatcctggggctttctgtggctctcccatcagtgccctggggctggcatatgcgacacctcctctgcctagggcattcaggcattcttcagtacttggtgagcacctcctagtgccaagctctgtcctggtcacaggagagcactcctgtccatgtgttgtccctgtcctcactgcgctttgggccggagaggagctcactgtctgatccttttccccgactgtggcttaaggggtttcgtctcttgctagagcccttctaggcaggcagcaggtcctggtttgtgagcaaggggctcctcctccattttggagcctcggctgccctgcctccccggtaatctggtattctggtagtgcctctctgggccctggtttaaaaggccgagagaagctgtattctggagatcagctccaggttctcccgcagagagcaagctccaggcacaggcaaagggtgtggcttcagagaagagcgaggatcttgccatctcttttacaggttggtgcagactttttagcagcgttaaacccctgattgctgtcatcagtggtgtgattttaccagatgctccctcagtactttacaatcaacctgcactgagcactttgtgcgggggcagggcctggtctggggactgtcaagtgctttatcttatctaagccttacctctagatccgtggaaggcagagagaatttgggaacctctgtgctataagcatggaaaattgggactcaggtaaaaaggctggttcctggtcgcacagctggtcatgggtgagtgtggtttttgaactctgatatttggattctgagtacagaacatgttatattgtggcccatgccctcctcctgagttcttcagttttaatcatttcattttctactctttttaggcactttggcaaaggagtgtgagttttggggaagctcaaggaagaggtaccaggtagagagagggccagggctgagttcacgggctctttctaaatggaaatgtctcacattcagctgttgtctgcctttgagtcacacagaaccacttgcaggaagaactctagagaatttgggaagaaagggggagaggacagacaaaagatgcatttttctttcaagaagcaggaaaatgtaaggaaaattgaaggtgttctcaagtgtgtctgctgctgcctgacacaggttaaccccgtcgcaggtcactccgctctgttaattgcatcctaaccttcctcggctcttcggcagcgaaatcgcagcagaggagatggagcagcttcgtgcgcattgctcatttgcgccaacgtgaaaagaactgccaggatgcccaggacaccagctccctggcttctgcggtgcttgcacagtcctgaatcagcccgagagctgtggatctgcgtcccctggctgcatagccgactgccggctccatggaggggcctgtgccggagaacgcacatgttgacttatttcttcagtctaggcctttcttggcccccttggttattcattctagatgatacaactcttatttcagttcaaatgtctcacggaagaggcattgaagacagagtggatgcccgtgtttgttggcagtaggtagtatttaccactccggctgtagtaaaagaacaaaaggagaaattacacctatttctcatatttaagggaaaagcaattaaatcaccaaagtcag

SEQ ID NO: 145 - DNA, 2068 bp, Homo sapiens
tagtaaacatattccattccctcccaaactttcctcatgcccctttttagttcctccttcccacctctcccctccccctgagctccaggcaaccactattctgcttactgttacttgtggtgtgttttctctcttttttcttcccccccgagatggagtcgctgtgttgcccaggctggagtgaagtggcacgatctcaactcactacaacctctgcctcctgggctcaagcgattctcctgcctcagcctcccaagtagctgggattacaggcatgagccaccacacccagctaatttttgtatttttagtacagatggggttttatcgtattggtcatgctggtcttgaactcctgaccccagctgatctgcctaccttggcctcccaaagtgctgggagtgagccagcatgcccagatggtttgttttcattttgcagactattgtagaaatggaatcctgcagtgcgcacttgttttgtctggctcctttcacccagcatactttgagattcacttatgttgctgttcgtacctttttttctatttttattttttgagacggagtcttgcactgtcgcccaggctggagtgcagtggccagacctcagctcactgcaagctccgcctcctgggttcacgccattctcctgcctcagcctccccagtagctgggactacaggcgcccgctaccacgcccggctaattttttctgtatttttagtagagacagggttttaccatgttagccaggatggtctcaatctcctgacctcgtgatccgcccgccttggcctcccaaagtgctgggattaccggcatgagccactgcgcccggcctgctgttcctacctttattgctgaaaagtcttccattgtgtggatacatcatgaattatttgtacattcacttgatggacatttgggcagttttcagtttggggcgattacaactaaaactgctatgagtcttcatgtataagtctctatgtggacgtaagtgatgctttctcttgaatgaatatgttgtagtggatggcaaggtcataggatatatgtacgtataaactcttgttgatatctaaaaagtaaggcatggtgaattacttgaaatcctataaatatatttggtaagagaagaagaaacgactggatttttttgtttgtttgttttggagacagattcccactctgtcacccaggctggagtgcaatggtgcgatctgggctcactgcaacctccgcctccccgattcgagcaattcttctgcctcagcctcccaagtagctgggattacaggcatctgccaccacgcctgactaatttttatatttttagtagagacggggttttgccatgtgggccaggctgatctcaagctcctgacctcaggtgattcacctgccttggcctcccaaagtgctgggattacaggcatgagccaccgtgcccggctacgactgaatttttctttctttcttttttttttttttctttgagatggagtctcgctctgtcgccaggttgcagtgagctgagatcgcgccactgcactccagcctgggtgacatggcgatgaaaacaacaaaaatcagatccccaggtgattccagtatgtagccagggttgaggagcagtgatctaagtagagttttgcaaacttgtctgtaaagggccagataataaatacttttcaaccttggggttgaaaggtctctgtcctcacttttcagctctgctgttgaagtgtgaaagacacgtaaccaatgaacatggcatgtttcactaaaatccatttacaatgacgggccatgggccagagtgtgctgagctggactgaaaggctaagtgatggaggcgtggctctgcctccagactggagcaatctgctccagacttcccaggcagagccagacccatcggacatgcttgcttaggagaagaataagcaccccagcattgaaaacaaaatgttaaaatgccaacatttgtgtttaattctagctacaaaagacaaggaaaagaataaagagaagaaattcaaggagtttgtgagagtgaagcc

SEQ ID NO: 146 - DNA, 2186 bp, Homo sapiens
ggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggttccgggcacagcgcgcctcagtctgcattgggctgacaccagagagcatgtggggattttcctagttgccgaagaagatattatttgacgttgctgtagttttgtgcttacttctcttggaatctgcagtggtgcaattctccccttgttttccccccttctctttgaaaagatatcaatgctatgttcagcagaaacggatacagcaagagcagcatagttcaaaaattgagggaggcatcttctctcttttcctgggatttaaacgcgatttaggagggcagatgccctacccgaaaaggccaaccgttaaagaccccggcagtgttgtggtccaaggcgtctcaaagcaggtggccagatctgcgtttctcatcagcagactcactccggctgtggctattacgaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccatagggtaaacctgtgactgagatcttactatcactaggttcccaccaacaggtcgtgcccaaaggtggcctgtaggctgcaatagtatagtctcacagagagtcaaaatggtatcattatatttcctttgtttttcctactaattatgttgcctgagccaacataagtgtttgttatattaaacaaacccatcccttttcacttgatgtgtaacactggttacttacccaagagagtaaaaaatcctattaaaaatattaaacagtattaaaagaagccctcaatggggcatttttctgtacaggtagaaactaaagtttgttttactatgaagaatattatttcattcatatgccagtctggtatgtaagatttaatcatatgtgacatttccataacaagatggaatactgggtaactactgtagagtttcttacttagaagacactagtatctgcagatgctagataacatggataagaatttgaaagcatgattctcatggaatgacagcagttaagatgctcacagaattcaattgtatatgagaatgggtttctgttttgtctcttttacattcatgtccactcatggttctcattaaagtggactatgaccagat

SEQ ID NO: 147 - DNA, 2134 bp, Homo sapiens
actgaacgtgggtgtcattgacaatgctgcggaagtcaccagagggcccttttaccaagcccccaggccagctccaattctattgtactgtcaccatcgtagcttctgttgtctgtgatctgtaccactcagagtcctcttatccagtcactatttgtttcctttgctgtcacctcttgttttcctctaaatgtggctgtccttcccaagcatgtctcaccttctctgccctcaccatgtcatttcccagcatctgctggtgtaactcaaagtctttgtgctgtcttcacccgctgttttgtaatctagccatggaggtccatgtgtgataatagtggccacttattggctacccactgggccagcactgaactctcacatgggacagtctttatttggatgttccattttcaataaaagtggactgtgcctgcgaggtgcagtggctcatgcctgtattcctagccaaggcgggcggatcgcttgagcttaggagtttgagaccagcctgagcaacatggtgaaaccccatctctataaaagatacaaaaattagccaggtgtggtggtgtgtgcctacagtcccctctattcaggaggctgagatgggaggattgcttgagcccaagagggaggtcgaggctgcaatgagccgtgattgcgccactgcactccagcctgagcgacagagtgagaccctaaaggaccacatcaaaactgctgtaacttctaatgtccctcaggcactaatactgctccctccctctgcgtgagcaccactcttgccccaactccaggcctgtcatgtcagaggccccgtcagtgtctgctaacaaatcctgtgtgttctccaggtcaccctgcatttctcttcctgctttgtcctcatcccaggccaggcccttgtgcagatgtggcttggccatctcacagggacctcgtctagcctaacaagcacaaggtcactgtgagatgactaactttcagttggcttctgcgtccaccacaccacagtgcgtgctgcttaagtgcttccgggatggcccgtccccctgctggctgtggctgggcgggcaccatcatattccaccctgccctgcatcctgtgcgctaggtggtgctggtgaatattctgcatccagcactgcttatgctgtttcttggcctctgaagatcctttattcttctctgcttttcttatatctatcgtgtgatcttgcccaaaatactttattcctctgggtctctctctgttcccctatcctgaaaataatgtgattatgttggatagtctctgaaaggttccctcctggtctaagatgaactcattcagctcacctatgagggccagctcaggcctcccacatgaagcttcccctaagtatcctgagcctcagtgtgcccttccccgtatacttctctggactcctttctaagggggagaagatggtgactccattttatattttgcttgccttgttggttagcatttttccctcatccttaaataaaaattccttgagggtaggactatgttaagagtagatctctttacgttttcttttaattttactctcaccgaattcttcttccccaaccaaaccaattctttggcttctgttgcattttcctcccttcgttaaggaaagagataccattgctatcaaactaagaactctgcaggtggtattctaaaggaatgatcttttcccaaggacagttttcacttggcaggagaggggtagttgggcgagcactccacatgcatgacgtttatagtcaccacatccttcaggctgtgttatgaccaatgggtggagatctaatattaaagtcaacagaatgtcctcagttttaatgcatttctgtgggttgtcagaactttagccatctatgtctggtgtccaaggattggatgtgcatttgttcgtatttctatcacttgtaataagtaaccatactacgttcttttgaaagtttgggaactggaattgtttgcatggaactcagaatgtttcatactttttttcctatagctttctctttatatggataagtttgaagaattccagactaccatggcaaaaagcaatgaactgtttacaaccttcagacaggaaatggaaaagatgac

SEQ ID NO: 148 - DNA, 2203 bp, Homo sapiens
ggcctttttttttttttttttttttgagatggggtctcgctgtgttgcccaggctggtctcagacttctggactcaagtgatcctcccaccttggccacccaaagtgctgggattataggcataagccaccacgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcggtggctcatacctgtaatcccagcactttgggaggcccagttggggggattacttgagtccaggagtctgggaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaagacagtggccaggtgcggtggctcacgcctgtaatcccagcactttgggaggctgaggtgggtggatcacgaggtcatgagttggagaccatcctggccaccatggtgaaacgtcgtttctattgaagatacaaaaattagctgggcatggtggcacgcgcctgtagtcccagctactcgggagactgaggtgggagaatcgcttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaac

SEQ ID NO: 149 - DNA, 2692 bp, Homo sapiens
actgcccccgccactcctttagactctggacgtgcggggactggtggcgctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccatgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcagaacttatacacaacacaaggtttcttctttgaatgcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttccttaagtatgacacaaatactcatatactgtcttttagagtcagtatagttggagctgttttcatttagtgctttgataatgatttacttatttttccaaatttcgtttgaattttctttcatgtgattgcattgatctatgcagcatttaccagaaaagagtattcctgggatagcagaatgcataacactgagtgttaattcttgtgaaataaataagctagactgccttctctttaattag

SEQ ID NO: 150 - DNA, 3154 bp, Homo sapiens
acaatggcaacggtcagctgggcctgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccacgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggc

SEQ ID NO: 151 - DNA, 2077 bp, Homo sapiens
aaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatgtaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcagaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctatctcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagtt

SEQ ID NO: 152 - DNA, 2095 bp, Homo sapiens
atataagaaggcttttgatattttaaataattttatatctcattaaattatcttactatttaaaatagtttttcagttctaaatcacaatgagataccacttcacacccagtaggaaggctgtaataaaaaagacgacaatacaagcattggcaaggattggaaccctcattcattgccagtggggatgtaaaatgtgtggcctctttggaaaacagtttggcaattcctcaaaaaattaaatattagagttaccataggacccagcaattccactcctaggcatatccccaagagaactaaaaacatgtccacacaaaaatgtgtataggaatatccataacaacattatttttgttgcggtggttgagacagggtctcgctgtgttgtccacgctggagtgcagtggagtgcagtggcatgatcacagctcactgcagcctcgacctcctgagctgaagggagcctcccatctcagcctcccaagtagctgggactacaggcgtgcaccaccatgcttggctaatttttgtattttttgtagagaatgggtttcaccgtgttaccccaggctggtctcgaacttctgggctcgagtgattcgcctgcctcaaccttccaaagtgctgggattacaggtgtgaaccaccatgcccggctagcattgtttttaataaccagaaagtaaaaataatccaaatgtccatcaaatgatgattggatacacaagatctggtatacctatttgatgaaatattattcagcaaaaaaaggaatgaagtagtgattcatgttacaatattaataagccttgaaaacatgctaaatgaaagaagccaatcacaaaagaccacatattgtatgattccatttatatgaaatgtctaaaataggcaaatccatagagacagaaagtaaattagcggttgccaggaattgggaatggggagaatgtgaagtgactgactgctaatgggtatggggtttctttctgggatgatgaaaatgttctggaagtagtggtgatagttgcacaactgtgaatatacaaaaatccattgtattatacacttttcaaatgggtgaattttatgataagtgagttatatctcaatttaaaaaaggaaaaatagtttttcagttgactaagttgtgttatctagaaatagcctcaaattataagtttactttttcctttctaatttttatgcttactattatttttcttgtaatagcattagctagtacagtaatccagaaaatgttaaataatttttcatgataatggtgatagtggacttctttgacttgttcctggtcattatagaaatagaaatgcttcttcactaagcatgatgctggcttttggggttggtgtggcatgagcacacacatgttttatcacattaagaaaatacctatccctatttctttataatctatggagatttttctttgatctcatattgcgtgatatattaacagattttgtaatatttaactcattttacattcttgaaatgatcctacctggttgtggtgtatacttattttaatattctaacattttacaatttttgcatagttagaaaaattgacatttatttatcataaaatgaatagcatgtacagcattgtttgtaatggctcccaaattggaaataatctagatgttcatcaataatagtctgtttaaagaaagtgtggtagagacatagaattaaatacaacgcagacattttaaaaatgagaaatatctatatatattgctatatccaagaatatccaagattatgtgaaaaaagaagatatgcagatgaatattttaaatgagattccatttgtgttaaataatgcccatagtaacagtagaaattatgtatgtttactcctatcactgtgcatgcatagatgatttcccgaaagatattcaaacaattaacagtggttactttagggtaatgctggtttgggggaagcagtggtatgaagggagggagcattcctttttactgtatacctgtatgtaatgtttcaggttttttcttaataagccatcttacctttataataaaaagttaatttttaaaaagtt

SEQ ID NO: 153 - DNA, 2057 bp, Homo sapiens
ccttcgggaaagggtggcctcgggccccctactctacagagtctcctcccacggctgcccagttccctggccgactatcttgcctccaccacatcaccatcagtaccgggcggctgcagggcagagctgtccagggacctcctcacagcctccagagtcaagaaatgcctcctcagggaagccctctaccgcatccctgacctgtgagtcacggagctcccgggcaccatgctggccacaaatgcctaaggagccccccggaaccagctgtgggtcccgcaggcactcgcaggctagcggacacctttggaggactgagagacctgtcctgcaatccaatgttcctcactctcacaagattttacagacgtggaaaccgaggcccgaggccccaaggggtaatcggcctgccttcccatgccaataaccggcagtggcgggacccacacctactccgtgacctgcaggcccaggggtcgagccccaggtagaacgtctagacggactccgcccttagcgccgtacggggaaccttctcccggacgcagacacggaagcggaagtgctgccgagctgtagctatggagacgtggggggcgggccgcccggagagcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattc

SEQ ID NO: 154 - DNA, 2771 bp, Homo sapiens
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgggtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgcggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggttcgtgaaacattccagtctgattccatctcacccaaggccaccatttcaggctgtcaccgaggaaactcctttgatggaagtctgtcctcccaaacttcccaggaaagaggcccatcacattccagaagcacctttcacttcccaccatgattctgaggccttctcagccatgtggaactgtaactccaattaaacttacttatgttcccagtttggggtatttatcagcagcaagaaaatgaactaatatagtaaattggtaccagtagagtggggcattgctgaaaagatacccaaaagtgtggaagcaactttggaactgggtaacaggcagagattggaacagtttgaagagctcagaagaagacagggaagtgtggaaaagtttggaactttacctagagacttgttgaatggctttgcccaaaatgctgatagcgacatagacaataaaaccaggctgaggtggtctcagatggagatgaggaacttgtagggaactggagcaaaggtgactcttgttatgttttagcaaagagactggtggcattttgcccctgtcctagagatttgtggaactttgaacttgagagagatgatttaggttacctggcggaagaaatttctaaacagcaaagcattcaagaggtgacttgggtactgttaaaggcattcagttttaaaagggaaacagagcataaaagttcagaaaatttgcagcctgactatgcaacagaaaagaaaaaccaattttctggggagaaattcaagccaactgcagaaatttgcataagtaaggagcaaggagcctaatgttaatccccaagaccatggggaaaatgtctccaagccatgtcagagaccttcacagcagcccctcccatcacaggcccagaggcccaggaggaaaaagcagtttcgtgggctgggcccagggtcctcatgctgtgtgcagccgagggacttggtgccgtgggtcccaactgctccaactgtggctgaaaggggccaatgtacagctcaggatgtgacttcagagggtggaagccccaagtctcagtagcttccatgtggtgttgagcctgcaggtgcacagaagtcaagaattgaggtttgggaacctccgcctatatttcagaagatatatggaaactcctggatgcccaggcaaaagtttgctgcaggtgcagggccctcatggagaacctctgctagggcagtgcagaagggaaatgtggggttagaggccccacacagagtccctaatggagtgctgccaggtggagctgtgagaagagggccactgtcctccagaccccagaatggtagttccactgacagcttggatcatgcacctggaaaagccgcagacactcaacaccagcctgtgaaagcagccgagagggaggctgtaccctccaaagccacagggtggagctgcccaagaccatgggaacccacctcttgcatcagtgtaacctggatgtgaggcctggagttaaagaagatcattttggagctttaaagtttgactgtcctgctggactttggacttgcatgccccctgtagcccctttgttttggccaatttctcccatttgaaacggctgtgtttacccaatacctgtacccccattgtatctaggaagtaactaacttgcttttgattttacaggctcataagcgcagggacttgccttgtctcagatgagactttggactgtggacttttgggttaatgctgaaatgagttaagactctgggagactattgggaaggcatggtaggttttgaaatgtgaggatatgagacttggaggcgcaaggggtggaatgatatggtttggctgtgtccccactaaatctcagcttgaatgtt

SEQ ID NO: 155 - DNA, 2271 bp, Homo sapiens
cttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagtgcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcactcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaatcagggtaattagcatatccatctcaatcatttatcatttctttgtgtttagaaacattcacagtctgcttttctagctatttgaaaatataaaatgtattattgccaattgtactcattctgcagtgccacagaacactacaacttattcaaatggaatctt

SEQ ID NO: 156 - DNA, 2143 bp, Homo sapiens
agatgcaaagtactttctgcacttctcacgcctgattttggctcatccatgaatgccttcagggggccgtggagctaagaacagctgcttggaaagaagccacgggccttgcagctcggtggagtgaggtgggagtctgggcagcgggacacgggcgcaagaagtcaaagccagagggtgtcttggaagtcattaacttcagcagcctctcaggtgcctgaaactgttctcggcttgcacacttctggtgatgtggagctcattaccccagagaggtagtctgtcctattttcagacggctctgactatcggcaagttttcttttgcgctcccgtctcttctttttctgtcatttcatgcttggttccttgcattgagctacagctcctgcccatctgtcccaacacaggaagacgggggtccctcagtcttcaccagctctgcccccatgcagcagcctcctcaaattgcactgggccaggggcagcctgcctgcatggcgggtacttctgtctctgtcgctatggacagagatgctacgtccaagacctgcaggatgtctgggcctggagaaccttgagggtcgtctagtctgtctccccgactgttcagatgaggggaccgaggcccagaggggctgtgtggctcattcagagttgcacagcttgacatccagaaatcagaatccaggattcctgactcccagctcagtgttctcgcctggcctggctaaacagcagggtcctgacctgtgctgtggggctggcagtactctctctcagggccgtgaagatgggatgaggagctatatgcacagggcctggtgcgagcaggtacaattgggggcagaccccactaccttctgccatgccaggataccctcctccaggttcctctcctgaaggccggacgccgcccccactgcccacaggcccctccccatgcaccagtccctcctgggatgccaaagaaccaaggggagctgggaaatgttgccttcaggttgggccatggggcaccccagctgcagccctcggactccagtgcctcccatgtcatccataccaggaagctccggatgtctgggggtccccttctcagctcctgaaggctgcgtcccccgcccccacgcaggactgcaggccacctgtccttggatctctccctccccacccactgagctgctccaggacttgtcaaatcccccacccaggtcccataagcagcagcaggggaagctggaccaagccctggaaggtctggggatgtggcttaaagtggccccctgcaaatgcaaggcctctggaagccctacatttatcctgggaaagggcatccggctccaggtcccccagctgccctcttcctgtctttggtgctccaggaagccgggcatgtgtacggccttgagcccagctgtgggctcctggagcaggggcatcccagttgagggagtcctgctttctccctgtgcccattccctacgaggtagccgggggtgggctcatccccagcagcaccctctcgctggcacacgagctccttcagctcgaggagctggctgctcacacacccacactcacgcacagctaagtccctgtggcctcggcttgtggagacgtctgccccgtggcctgaacatccttcctctcccagatgctcaaggcctggcctggggtgcttcctggaaatgccacagactccctctgcactcactggtcacacatttccctcctactggatttttaaataaatgtttccaacagtttgacccttaaaacctggaaatcggctgggcatggaagcacatgcctataatcccagcactttgggaggccgaggttggaggatcacttgagtccaggagtccgagaccagcctgggcaacatagtgagacccccatctctacagaaagtttcaaaaagctgggagtggtggcccgtgcctgtagtcccacctactgtggaggctgaggtgagaggataccttgagccagggaggtggaggctacagtgagccatgatcctaccactgcacttcagcctaggtgacatagcaagaccctgtgtcaaaaaaaaagtacccccacattggtttgttatgggttgaactgtttcccccagaaatacagctccaagtcct

SEQ ID NO: 157 - DNA, 2966 bp, Homo sapiens
cttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggaaacctgtccagtttaagtcgtcttggtctgagatataacagactgtcagcaatacccagatcattagcaaaatgcagtgcacttgaagaattaaatttagagaacaataacatttctactttaccagagagtcttttatcaagtcttgtgaaactgaatagtttgaccttagctagaaattgcttccagttgtatccagtgggtggtccatctcagttttctaccatctattccctcaacatggaacacaatcgaatcaacaaaattccatttggaattttctccagagcaaaagtattaagtaagctgaatatgaaggacaatcagttaacatcacttcccttggattttggaacttggaccagtatggtagaattgaatttagccactaatcagctcacaaagatccctgaggatgtgtctggtctcgtttctcttgaggttcttatcttatcaaacaatcttctaaagaagcttccccatggtcttggaaaccttaggaagttaagagagttggatctagaagagaacaaattggaatccttgccaaatgaaattgcatatcttaaggatttacagaaattagtcttgacaaacaaccagttgaccactcttcccagaggcattggtcaccttactaatctcacacatctgggccttggagagaacctacttactcaccttcctgaagaaattggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacatactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttatttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatccacaaaactaacaggataattgggcaaataaattacatataaacacacacaatctatatatgtatatacaatgctatatagatatgtatttattatatcataaactacagtaggtaactttaaggatttcttcctatccttgtacaatgacatgaacgtctttctttgaaaactgcaatgtatgtatgtttcaaggttatttaacagtgtactatggttttatatcttgacttgccttgtacatctttcaattctggaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgttttttttttttttccgtttagttgggcgttgtgttttacacaaaaccatttttgaattaaggctatgatattaagatagaaatttggactgttgttctgcttttcctggcactcaaattcatgactagttttgaggtcaaacctatgctcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctag

SEQ ID NO: 158 - DNA, 2642 bp, Homo sapiens
gcagcctgttcgggagcctccaggaggagcgagcgcaggatgccgacagtgtgtggcagcagcagcaggcgcatcagcagcacagctgtaccttggatgaatgttttcagttctacaccaaggaggagcaggtcccgccctgggggtccatgccccggccgggaagggggctggctgcctttggtgggttggccacgtgctgcgggggcctcacagtccgggtggtttgctttccagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaattttttttttttttgtggtggggggtctccatatctagacttccaacacccaaggtccatataacccaaggtcgaaaaccttcctgcatcattgggtgctttgctgcagtttggccactagaggatgctatcgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatg

SEQ ID NO: 159 - DNA, 2339 bp, Homo sapiens
aacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattccttttttttttttgagacggactcttgtactgtcacccaggctgaagtgcagtggcgcaatcttggctcactacaacctccgcctcctgggttcaagtgattcttttgcctcagcctcccaagtagcagggattacaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaatttttttaaaaattaaaactttaataaaacagtttttaattttttgctaggttcttttaaaaatgatgtaacttacatggaagtcttcacaggactttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggatttttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacacc

SEQ ID NO: 160 - DNA, 2337 bp, Homo sapiens
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccctttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacagtatgataataaaacagtggtcctgaaaactcttgccaaatcagttttgcaagccaaatcattattaaaagtgcgggcagaacaactggtctggtttccactggagtaccactctgagctcttcaaggtatggctgaaaataacagctacacatctacagcttaggatactggagatttaatgagaaaaagtaccaaaaggttgacacatggctttacgttttgccaacccttgacatacaaggagtttgaaaagcagaagggaaggacaattcagtatctacaccagttggctcttgagattaatagtaaccccagcatctctctgaaacgaaaaaagaaattaattaaggaatttcaaaaacaccatccagaagctttgaattaacatttctgatacaagaaactacaatttttggggaggaagttagtatacttccagtggaagacctgagagggtacctgaagagataccgggaaaatattggaaacatgccaccaagccctcttcgacagaagtctccttatttggaaagttgccattttaatgttcagtgtgaatcaggggcggggtcaaacactgttgcccaggctggagtgcagtgacgcgatcctgactgactgtaacctcaaactcctggactcaagccatctccctaccttggccacccaaggtggtggaattgcagaggaaggctgaggcgggaggattgcttaaacgcaggagtctgcagctgcaatgaactgtaatcccactactgcattccagcctgggtggacagaacaaggccctgtctctattttaaaataataataacacaaaaatgcccctcccccatttttttttaaagttcagtatgtaacaagttctatactggatcctttctttctctaataatcctcaagaaatccttacaggtaagtattgcttccgccactgcagaggcgaaagccagtgctttggtaaaggtcctagtctttctggctttaacacagaaagtcttaataccatttggattagagattcacaagttaggccgggcgcggtggctcatgcctgtagtcccagcactttgggaggccgagacaggcagatcgcgaggtcaggagatcgagaccatcctggctggcgcggtggaaccctgtctctactaaaaatacaaaaaactagccggcctggtggcgggcgcctgtggtcccggctgcttggaaggctgaggcgggggagtggcgtgagcccgggaggcggagcttgcggtgggccgggatcgcgccactgcattccagcctggacgacagagcgagactccgtctc

SEQ ID NO: 161 - DNA, 2866 bp, Homo sapiens
gcgccgggcagtttggggttaggaaaggatgggtgccgagccggggtgaggggagcgggcggaggggactgtggggaagtgtcgcgggagtgccgggagttgtggaggtgagcagcgggaggaggcgttcccgcgtgtgaaaatgaagtgcagcctttagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggcttagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 162 - DNA, 3016 bp, Homo sapiens
tgtctcaagaatgtgcaccataagccaaggaaacaggccaggtgggtcttcattattcttattttgcaaagaggaaactgagggcagcataaatgaagtggctggcctgagatcacagaatgaagacgaggttgatttaacattgttgttgattcattcattccattcctacttccaaaaaaagactggaagttgctttgaaaagaaaatgatgtcctcagggctctgctgtgcccccgcatagtcagcttgccctctcttgcctgtggacctttgcacgtgcttctccttttggagcgacgttcacttttctgattccttactgtcccttaggtttctgttcagacatcgctttctccaaaaacccttccttgatactccctccccgaacttgaagtctgtgttgaaggcccttcctgtgcgtttttgaaggagcctgcatttctgtcatggcagaaccccttctcccagccttttcaaggtgcttattgttttttcttccctaagttatttccccaagaggagagatccatatccaccttgttaacaagtacagccttagccaggagcatcctcttggcacagaaatttcaccaatacaatctttttaaaaagactaattgaccaagtgaattcctggatgacaataaagagtatattttgaggaaaagaaaaggtaattttatcagaagcttgagctgcaatagttaccatagtagagcaccatatttggctctgagcttcctggcagccaaggcaaaaatgtaaacatggtaagttttataattttcattgtctgttccaggagaaacaagttgggattttttttttctaattttaagtccaaaatgtgattacacataaggaacactgactattattaacaggcggtgtcttcagtcacagttcatggtttccaaagtggaatgagtgaggccttcacactgacttgaaggtggggatggtgtttctccggggagcagaagtgacatggccgatcccagtaggctgtggcccactgggcttactggacagatgggcagggcagagccagctttgttttaacagctaacacaggtgccaggccctgtttgaaatgctttataaggattaactcacgtaattttcacaacttgataagggtaggtgctgtgattattaccctctttttacagatgagaagactgaggatagaggagtccaggagtgtttccatggtcacatagcaaggagtggcagagcgaggatttaaattaggcggtcaggccccgggacaccagctccaaaccagagttgggaggaggactcactttggatgcaaaatctaagggggtgccaaaaatctcagaaattagcaaaacctatcttttttaaaaatcagagtttatcagaaaaatccacaatgaacaaaataccaaaatgttgatgttttaaaaaaatatatatatatataaatttaagacatgcatctacatggctgcctccttcgcctcaccagatcctgactctgctccaaacctgctctctgctgctcttagcacagcacagttcttctgagtaagggatctggaattagagatccctggagtcccagtgtgctgctgacaagctgtgtggccttgaactggtcactcagtttctgagcctcagttccacatatgctagagggcagtaatcatagtactgtcccccaggactgttagagtgttcggggtgataatgcccattagatgcttgcaccataatggagctggccatgactgttgctgtcttgtgagttttgaggactctgaggtcactgatgctctctttggtggcccctgcatcaccctcgctctgctgtcattgtcattcaggttgttgcaatgtcccatcctttaggaggtcagccttcgggccacccagcaaccccagggctgggctggaggcagttggctcagggcaggctgctccctggggtgtggctcccacagaggtgtggggctgggaagagggaggtgcaaatgggatggagctcatttttctctccccctcccagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaaccc

SEQ ID NO: 163 - DNA, 2672 bp, Homo sapiens
gtgtaaacatctctatggggtgatgcatgcagataaatgtttatgtgaacatataaagtctgcatgtgtgggtgaacactccacatcaggtcattgtccatcattacatatctgtggtgtctggctcattcgtctcgttttctgtcattttacctacttttacctgaagtacaatgactatttaataactattaaatgtttcatttcagctacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtggctataggtgataagccggctgttcttcactgacctggtcttaccttgaaccctggagttctcacatgcatggatttaaatgctgtgtctttctaagggcacattatggccattttccttatctccctcccaaggggctgtttgctgtgtttattgactccctgtttaaaaaacatatatatatatatatatatagacgaattaggttgtaccccataaattgcatgtttgaaaaatatttcaaagaatggtttatttttttttgctgatttttatgtatcttctaaattgtatatatttatggggtataaaatgatgttgtgatttttcaatacagtgtggaatgagaatcaaattaacctatccgttacctcaagtacttgactttttttgtgatgagaaggctgtttatcactttcactcaccagctcctgctgtcttccatgctggggacaggaaaggctccacgcttgactttccctcctgttttcttatctgctgtcaacccctgaatgtaccctccaggattgccttctagaccttctacatctagctcgatcattgtgcacccaccttcctcccagggactgtccttagggagtgactttatgcacaaacttcacatgctcttcctgcctccttcatccccataagcccccatctcagccccatctgattattttccctgtctcatttcctgtcatgctgttggttttctaacctgaagggtaacttcttactccttagttttttgccttaatttctaagtcataggctactttcaggctaaaagttttcctccagccatggttttagtctcattctataagtcttgctaggtagtttattcattggaaattttttgtttttgagacagagtctcgctctgtcacccaggctgtagtacagtggtgccatctcagctcactgcaacctccggttcccgggctcaagcagttctctttcctcagcctcctgagtagctgggattatgggtgcctgccaccacacccagctaatttttgtatttttagtagagacggcatttcaccatgtcagccaggttggtctcgaactcttgacctcaagtgatccgcccaccttggcctcccaaaatactgggattacaggggtgagtcaccacaccccaccccttggcactatatttaagtgatgatatttttggacactgaggtagcctcattccacaggtttagatctgaagcattttcactattgcttctttccatgtatttcctggtttgcaggtcagtttcttcttttaattcatcattgacacagtggtttatatggcttttaatttcaaaagattttttaaaatatctttttgccgatttttatctatgttaattttaactagacatgttccctggaaggacatcactagtttttttttttttttttttttcactctgtttataatttaggtggattttcacatctcaagccagctaagagtatgggaaataggactcgttaaagcacagatatcacacaagtgattcagattcacgagggtaatccagatgaaggtatatcattgtacctggcccgcatcactcagtaactgtcacctttgatttattgatttacttgagatggagtttggttctgtccccgaggccggagtgcaatggcgtgatctctgctcactgcaacctctgcctcccaggttcagagtgattctcctgcctcagcctctttagctgggattacaggcacccaccaacatgcccagctaatttttgtatttttagtagagaggagctttcaccataatggccaggctggtcttgaaccccaaatgatctgcccaccttggcctcccaaagtgctaggattacaggctggagctacagagcccagcctgtcaccttgatttaaatgaatgcagctttcttggtgtcttgatgtttgtgaatttctgtggagtttgatactgctccttttgctgcttgtttttccagagtccccttatcacttgacgtgctgttatattatgtttgatttattacagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctggg

SEQ ID NO: 164 - DNA, 2706 bp, Homo sapiens
aaattagccgggcgtggtggcatgtacctgtaaatcccagctactcgagaggctgaggcaggaggatcacttgaacccgggaggcagaggttgcagtgagccgagatcgcaccactgcactccagcctgggtgatggagactccatctcaaaaacaaaacaaaagtatcttctgcccctcaaacagaggactcccttcttccaactggccagttccacaactcctgaacttttcctgttgttttctacctggaaagctccttcctgccagcctaaattccgctcatctgaggttcagtccaagctctgccccctcccaaaaacgttcctgggttgccgagaccccttctcagagcccttggcttaagccagacctctgcagctttggtctgccccttccgtgccttgagttcccctaaaatctcttaaggagtgaagtcttcagggacagggaacttgctccgtcatcctaggagatggagatgtagggagagtactccctcaagtcaggtggcgggcagcgaaacccaggctctggagagacctctgcctttgtgcttggatttgcagctgggaccttccctgatggtcagggctgtgcagcagagaggccaccttggtttcagctattcgggtggaatggaggggaggccagaggccaaaaccagaatgagaccaaaaaatgagcgctcaccagggcccagcccaggcttagcattttcacatttctttctttcccttgactatctccatttacagatgggaattgaggcatagggtgatcaagtgacttgcccaaggtcacacaggtggctcagaagtggcagggctgggatctgcccatcctccatgccacagatgcccagcctggtagtgggtcactgcggaggcagggcagggactgcaggaggacaggtggctggaaagcaatcatttcttagtgagtccctgcggggctggctctctgctgcatgcaggaaaaggacgggggttcccgaggaggcgtggggtactggtctggctgcccaaggctccaaggcccttctagctctcacggcctgtgtctatggccacatccaccgtggtgttcggctcctgcccccaggccctgaatggaggcagtgagcagcgtgctccaagatttctgagggcttcccacaatggctgagcatgtcctgatggaccagggacagccgggtggctgcagagggagggacagaggaatgggcaaatctgcttgtccttctcaagtgccagcctgtcttccagatgagacgtagtgtttagggcagagctgggctggtccaaggcccttcctacaccccggaacggggctcaggtaccccaggggccctgacactgcagttcccgaccaggatcgccgtctgtgatgaggacaagctgagtcacaatgagtttattggggagatccgcgtgcccctccgccgcctcaagccttcgcagaagaagcattttaacatctgcctcgagcgccaggtcccggtctgtgtgggggctgcaggggcgccaggggagggggccctggggaggccaggcttccagaaccttctctttgccccctcagctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggtggcgtgtccctggggccaggtgcccgaggcgaggctcggaagcactggagtgactgcctgcagcagccggacgcagccctggagcgctggcacaccccgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaagcctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgagg

SEQ ID NO: 165 - DNA, 2712 bp, Homo sapiens
ggcctttttttttttttttttagtagagatggggtttcaccatgttgcccaggctggtctcgaactcctgacctcaggtgatccacccgcctcggcctcccaaagcgctgggactacaggcgtgagccactgtgcccggccaaacctggctaattttaaaaatttttttatagagacggggtctgtgttgcccaggccgatctcaaaactcctgggctcaagagatcctcccgtcttggcctcgcaaagtactgggattacaggcataagccactgtgcccagccaagtaattcttattttagaaggatgtgtaagaataaaggcatgttccactttcagcaagggactgggaaaaagaaaagaataaggatatgtacaataacatatacatattatataaacataacatacaataaaaatgctcaaactgtctataatcttttataagatcatttgtttatgattttactttcacatacatgtgggtcacaaacgccaataactattttaacatttgcaaatttctcagcaatactgcttgttaattagtaaataccaactgtatatgcttcaaatattacacttacctgatgttttataattctcttatacagtcactatttgaataaacaagcactgaactatcaccaactagaattttaaactgctatagaaatacagtgctactgagcaaccctaaagagtctctgcaacttagaaaaatcaaatttcttactttatttagatcttcatggagaccatccattaggaacagaagcaattcttgtgaatcttgctgactgtatcctgcaaactggtcattgatcttcccaatggtgattttaaagtcctttggactgatatatctatactgtcctgtccacagggctttcatgattataccaaattcttctgccacttcacctttatgccccaacaaatttgacctgtgcaaataaaagttgttacaaaagacaataaaggaaatttaaaagttaagcaaggtacagtagattcttgatgtcaacatgaaattattcacatactgtagcactacattaaactacttatttatttgcaggctcaccaccagattctcatctgaatctgacttgcttacatcccttcagcttccttcttttggctgcaagccctgcatggtctcctcatcatcaacaggctccagttcatgacagcgaggttctgccttctggcactgctctcatcctgtctgtcctttactaatcagagaaggctttactcttttttgagatggggtctcattctgtcacccaggctggtggagtatagcggcacaatcacggctcactgcagccttgaccttctgggctcaggtgatcctcccgccttagcctcccaagtggcggggactataggcatgtatcaccacacctagctaatttttgtagagacggagttttgccttgttgcccagactggtctcaggctcctgggccccaggtgatctgcccacgtcagcctcccaaagtgctaggattaccagtgtgagccaccatgcccagccttcattattcctaaggataaagatattttcccctttcctaatttgacttttctggagctgagtggtaagtactatggtttgaaaggtaaaatgggttcttgatgtcaacatgaaattattcacatactgtagccctacaccaaaatgcttacttattcataggttaccaccagattcacgtcaaatattccaaaattcaggtgttgccaatgtgacaggattaagagatggggcctttaaagaggtgataaggccatgagggctcccctcccgggtgaacaggattaggtgccgtttagggctcgacaggacgagtctgtcctctttcgcttccaccttctaccctgtgaggatgcagcaaaaaagcgcaccagatgccggcacctagacgatggccttcccagtcaagaactaagagaaaataaatttttgttctttacaaattatctagtcttaggtattttgttatagcagcagaaaactaatggactaagacagtaaatatggttagatcatccttttagcattataatgcaaaaagtatgacatgtatttacctgttaatatcatcctgataacagtttcggttgaaataatcagccaaatgtggagcgttacataggcactgcaatattgagttcatataacaagtatttcctaagttacgaagtccagtaagagctggtccagaacctccaaaaacaggattgaggttccgaatctgagaagcagaaagccttgagacctcagctttaggataacatgttggcctgaggaagaaaaaggatacaagatgtcttaaaatgctgagcatatgaaattaaggttctatactataaatggcagcaaactgtagcacctgtaccacaggcatcttgtaaacagttaatatgttaactcataagatgctgggccttccaggacatttaatatttaggttaacattagtcatacgactaaggtctcagaccttcccatgaaacacatacctttaacctcttaatgtgggtcatggttcttagagacaccttgagatagattatctcacttctcatgaactaggagctctagtagagaaggctcttttaaactcctttaaatgatccctggaagtttggcattatcaaatgtttgaactcacccagaatgccaaatgaggaataat

SEQ ID NO: 166 - DNA, 2814 bp, Homo sapiens
agcctgcgccatgggctgcgacggccgcgtgtcggggctgctccgccgcaacctgcagcccacgctcacctactggagcgtcttcttcagcttcggcctgtgcatcgccttcctggggcccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatatatgatggtgtgctactgtgcaccttgtctcaactccactcttcgtgatagcatgttggtagcttgaaatcagcctggtgggagtattaccatggacactggcaaaagctacagatcccggagagccagtggttaaacatttaccagcataccactgctagtaatcaaggctaactggtccagaaatcgcccaggagaatgaaatggatgttccatttttttctactgacattgactagcatataaaaggtatagaaacagcactaagactttctgaaaatacctaatgaaaattttacatctttttttgtttttgtttttgtttttgagacagagtctcactctgttgccaggctggaatgcagtggcgtcatctcggctcactgcaacctccgcctcccagtttcaagcgattctcctgcctcagcctcccaagtagctgtgactacaggcgcatgccatcacgcacagctaattttttgtatttttagtagagacgggatttcaccgtgttagccaggatggtcttgatctcctgacctcatgatctgcccgtctcagcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaactt

SEQ ID NO: 167 - DNA, 3143 bp, Homo sapiens
tctttcactcttgggcctagcgaggcagcttatttttcctttttctttcattggtcacagttatttcttttcagtgtgtcatcttctctaagtttctgagggagtgttagcttgaggccttgccttgacataatcagatataatcagaaaaatgaaaaattccataggaaagagaactattttagccaaggtgtgcgagagaagtaccgccactttcaagcactgttttcttctactggagtctgctcaatagggacgtcagctttgctggggcttcctttgacaagagaatcagaaccgactggtgacatttgtttcaatgaaagcaacagtgtgaagagtaagtagtttttcctattattcatctcactcagtggagataatgaactcctctccactgccaagatgagaaactaccatttcttacacatggacacaaagatgagaacaataaacactgagacttcaaaaaggagggaaggagaaagaggagcaagacttgaaatctacctatcagaacttgcaatttattctgatcaacaatttgcccagctaaagtactacatctgccccctcttcctgtggctgtaggggcacagcaaaggtcactggtctaacctccttaaagggactccgctaacagatcttcgcctgctgctggaaatggccctctcagtggactcatcgtggcatcggtggcagtggagagtcagagatggcttcccccattgtccatcggaaaccacaccgctgctctctccagagaaagggagacagagctacaacttgacacagcagcgggtcgtgttccccaacaacagcatattccatcaagattgggaagaggtctccaggagataccctggcaacagaacctgcacaaccaaatacaccctcttcaccttcctgccccggaatctctttgagcaatttcatagatgggctaacctctatttcctgttcctggtgattttgaactggatgccctccatggaagtcttccacagagaaatcaccatgttaccattggccattgtcctgttcgtcatcatgatcaaggatggcatggaggacttcaagagacaccgctttgataaagcaataaactgctccaacattcgaatttatgaaagaaaagagcagacctatgtgcagaagtgctggaaggatgtgcgcgtgggagacttcatccaaatgaaatgcaatgagattgtcccagcagacatactcctccttttttcctctgaccccaatgggatatgccatctggaaactgccagcttggatggagagacaaacctcaagcaaagatgtgtcgtgaagggcttctcacagcaggaggtacagttcgaaccagagctttcccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatggtatagaagctcccaagggctccatccctctttctaaaaggaaataccctgctctcctaagaaacgaggagataaaagacattctcctggctctcttagaggctgtgtggcatttccacaagttgcttcctgtatccctgtggtcttccttgtcacagatcagggctgttccaattacttgtaaactttcatttgtttacaaaggttagaagttatcccatatgtggttccccttcagctgatctttgtctggtgccagacaaagcactttatgagacgagttttttatctgtcagcaatggattggagacatttcccaattgtgtgccagtcacacaaccaaggcttaggaatttctcaggccaccttacctgacatgtcagggcaggtctgtgtctaggtgcatggtcagatttaatacatccagaagatgtcttctattctaacagatctcttagcttgtcactgaggcaaagttttgatttaggagatagggctataaaatgcctggactgttaccttgcatggactgaatatgactcataaaactgatctgattccttcagccatcatctgcccaacttcgttcccctccccacccccccacaacacacacacacactttctaagaaaagaaaagaaattcttttttttcaatactttaagttctgggatacatgtgcagaatgtgcaggtttgttacataggtatacatgtgtcatggtggtttgcagcacccaccaacccatcatctaccttaggtatttctcctaatgctatccctcccctagcccccaaccccccgatgggctccagtgtgtgatgttcccctccatgtccatgtgttctcattgttcaattcccacttatgagtgagaacaagcagtatttggttttctgttcttgtgttagtttgctgatggtttcctgttcatctgtgtccctgcaaaggacatgaactcatccttttttatggctgcataatattccatggtgtatatgtgccacattttctttatccagtctatcgctgatgggcactggggttggttccaagtctttgctattgtgaacagtgctgcaataaacttacatgtgc

SEQ ID NO: 168 - DNA, 2116 bp, Homo sapiens
tcgaaaggttggtggttcgtgcccacccagggacgccaagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtatgtgaaagtggaactgtgagctttatgaccagctgtgagtctctttgtatgtgtatctatttgcaaagctaaagtttgttaagacatgttcatgcctagaaatagatgtggatctcagtaaggagtgacatatgtggcaatgatacctttccatactgtggatatcattggcacagagtaaatactgaaagaggggagtgggggacctcaatgattggaaagttttcattgcgcaaaaagtgtgatttggtcataagtaagactccatgtcctgtgcacattatgaatgatgtaaggcaacttaacaattgtcagctatttcttttcattgttcttattttgggaaatgggtgaaatgtcagtaagttgttggaagaaaaaacatacccttttagatcaatatgacatttgcaatgattagacctgattacagttgaaaatgttgctatggttacacattgtcgacatagtgttctgtaatttagatggacaacttttagggtttagagcatatagtcttttattttgttcagtatccatagttggcagagtagttcttaaattaggaaattatcttaatatcaaattctgtactggaagttttaatatttcaaattatattttccccttgactataaaatattatatattagttgtgaaaaatatagaaaatacagaaaagaaaaaaattaaattgcatataattccaccctctagagaaggtggctaatatttggatgttttaggttaatgtgtatatacgcacatttttatgtagttgagatagtctatacgtatatttttttattttactttttctagtttaaattataaacattttcccatgtctttagaaattcttcatgaaatattttctacggctagatcttaattcctataatagtacttggcaacatggtaagtaatcagtaactattttctgaatgcattgatggatataatgttctgttgtatggatttatttaggcaataccccagcattgctagtgggtcttaaatcctggattttattgagcttcaagtgatacttcactttagcaaacgtgacttagttaattgtaaatttttaaattaggtttttagtttaacttttaattaattataagcacaggaaaaaatggtacttaaactctgacatacttgaaaaatgtgttgggccaggcgcggtggttcatgcctgtaatcccagcactttgggaagtggaggcgggcggatcccttgagtctaggagatcagctggctaacatggtgaaaccccatctctgctgaacatacaaaagttggccgggcgtggtggcacatgcctgtgatcccagctactcgggaggccgagacaggagagtcgcttgaacctgggagcggaggttgcagtggaccgggattgcgctactgcactccagcctgggtgacagagtgagactctgtctcaaataaataaat

SEQ ID NO: 169 - DNA, 2823 bp, Homo sapiens
gaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccaggatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaaatctgaaagatacatcatttctatattccttgcttaatttttataaaatattgggttttcccttaagatagttgaagtatttttcttgccatgcctatttatttttgcaaaaaaattatctgctatatggaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaacggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattatt

SEQ ID NO: 170 - DNA, 3240 bp, Homo sapiens
tgtcttttcagcccctccaacctgtttgatcattttcctctgtggctatgattgctttaagtagtgttacttgtagattatttggaaaatacaagagagtgtaaagaagaccgtgtatggtgggcttctagggtcaggtccagggggcccggcaggggtcaggttggagccccaggtgcatgcagttttctctcccgcagcccacagagcagttcaacgggcagggcgccagcttcaacgggggcagcgtcagctacagccaacctggcctgagtggggtagggggcctggccgggaggatgggccgggaggctcacagggtgggcatatggagagagggcgaccgggcaggcacccctggggccgcctcctgtccacctctgttatcatggttcccagtgggtgcgccgtgaacagactccactcccatccaccctggcaatctgccttgactgtttgtgctcaaccctacagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccaaggtgggtgggtgggctctcagattcagctctgtgtaaagattctctagcgggctgcgctcccaagttcccctgctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctg

SEQ ID NO: 171 - DNA, 2013 bp, Homo sapiens
aaagaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccccatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgtgccccccatcgcttcgcagcccctcctgctccctttggctggctgttgcttccttccagcgtctgctcctccgcggcctcatctgcctcttcgtctgttagagcgcgcgtctcgtctcagtcgtcacgtttttggtttttgtggggttttttttttttttttttgagacagtcctgctgtgtcgcccaggctggagtatagtggctcaagctcagctcactgcaacctccgcctcccaggttcaagcaattctcctgcctcatcctcccaagtagttgggattacaagcacccaccaccatgcccagctaactttttgcatttttaatagagatgaggtttcaccaagttggccaggctggtcttgaactcctgacctcaggtgatctgcccacctcggcctcccaaagtgctgggattacaggtgtaagccaccgtgcccggccatcgtaatgtttgaatttgcttttttacatcttccatccttttggagtgtcttgttccctcgtcatagttcagcactgtgaccaccttggggttagacactatggttttatatcctgtacttgatattctcgagtccaagtctcctgat

SEQ ID NO: 172 - DNA, 2440 bp, Homo sapiens
ttatgctataatgtgggctggcccgtgctgcccagcagaactctcagctgcctctcagctgtctgtgttgtccagggtggcagcctctggctgctcatggtgctgaatggcacttgaagtgtggctcatgcagccagggagctgctgatttaattgaactgaaatagctatcctggcccatggcaccatgttgcacacacacccccaaaggctggtggtgcccatttgctgtgcatctgtgcaccttctcatggaagtctcattccatcaaaccacattatgggttatttcacagatgtgtacacagagaggggaggtcccatgtcccaggtcacacgcagccagtcagcattagagctgagatgccaagctctcagccacacatgtgcactcacctggaacatctgtggagctgttagaatcgctgccacttttcatgaaactgaagtgcatctttgggtttgcaactaaagaaaccagctgctacaatgtcactaacataggattcaaaagcccttcggatttctggcagtctgtgcatagcaccctgcctcgggagttggctccttgtctagtatttaatacatccccaaacttggctttattttcagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttc

SEQ ID NO: 173 - DNA, 2697 bp, Homo sapiens
gaatgggacctcattcggacaaaagggtctttgcagatgtaattaaggacctcaagatgaaatcctcctggactaatcaggtaggcccgagaccccatgacacagacagagacacagggagagttccatgtgacagtggaggcagggactggagtgatgtatctgtgcccaaggaacaccaaggattgccagcagctcccaggaggagatgggatggagctgacgctctccagagccttcagaaggaaccaaatctgatactggatttccgtcctgcagaactgggagaaaatgcatttctgtttgaagttaccaagtttgtggtcatttgtgagagcagccccaggagatgaacacagggtggctccatgccaggacaggggggcaagaggctggggctctgtgctcctccagggctcactcaggctcactctgagcattcagcgcagtgtttggggcacccggtgaccctgggtgtgaggagacgtggtctgtgccttctggcccatcgtcatttgctctgggtgctgatatcaaccacaggcaatttaattctagactggaatggagctgggaagggcgcaccttcctgccaaaagcaatttcgtccaaagtctgcacctcggtggctgagcatggcgggccgggatgttttcacactgccactctagaaagagcggaaatgcagacgctttcctccttcacaatttttgattgctttgacttttggtgtgtccgagaggctgtaactcaaataaccgttccccacctttggttagatcctagagtctctggtacattgtccgtcagcggtgctgcttggaggcttcccaaaggccgccattttggtaggctcattgagagatacagaagaaataggagcaaacggctccacagtagagatacaagcagcttctaccttcaaattactgtggtttttatttgacctgttggaagttctggggtttctataaaggataaaaactctctttgggcaggcacagtgtagatctgaaaagtcctgactacggccccttcagtttatggcctgaggagcttgagggcctgagggaagccagtggccggaacacacgggctctttagctgaggagggacttgaacccaggtgttccgacgcgaggactctctcccaccacatacagcacagcactgcttgcgttgtttggttttgtattgctttggaattagtccaactatcatcatcgatgtgaataaatagacatatatcttttcagtttgcacaactacaaccataaatgaatatttattagtgtgaagacacccccaggtcctggaacactcaacacatgtagagccaggtgtattcaggagtccatgcagcaggaagtggagccatcatcacagggtacgaagggaggacaagtgcagtgtcgtgagcatgtacagagggaagttgacagcggggagaggctttgctgaggaagtggcgtttggaagaacgagaatgagatggggttttgccgtgttacccaggctagtcacgaactcctgtgctcaagcgatctgtctgcctcggcctccaaagtgctgggattgcaggcatgagccaccgcgcccagccagaaagccactgctttatagaccaccacttaaatgcacctggcagcttcatgtacgcgagaactttcctgcagctcctttaaatttaagaatcttttggcaaaatgaagaatacaagcgtgtttcttcttcatatgctttgttttaggaacattaaaaaatatagttactacaatcagaaagcagttatatttgtatgttttgtaacaaatactgtggcctgatagaatgagcttctgacaaaggcatgtgctttccaagtgggccaagttcaaaagttgtccgctgagttgtctcactggctcatccagccaatcattcaaatatttaaaggccccactaagggccatgttactcattgtacatctttaaggatgggtgtaacttacttatctgtttattttcaatttcagaatactttatattgactcctaaaagtatggtgtagtgtatgtttgttttgggagtttcaatacaatccctaaatttatgtatctcaaatgtacagggactgatcaaattagtgctaattttcctaaaacagtgtcaaaaacaagggaatcaatcatgaacacactaagcatgagcatcgactgtcataagacatggctcagtttattttttcttccttcttactacaccgtagaacagagctcttttgtttgcttatgacctgggcaaatatgctgtatgataaaaaaaaatcatgtatgcatttgattctcatccagatgcccttaggataagaggttcattttcatcttctgttttccaaatgaagctttaaatctaattagatcttgaaagaaaataactgcaatagggtttctgtaagtaaagggccctcatttaaataatgctgttatttgtttatgtgatttacagtaagtgatgaaactcttcgtggccagcacgccgctcacttcggggatcctttgcacagagcactttgagttagttataaaccattctacacacagaagcatttaattgttagaacatttcatagtgtaacagcatttctcattgcctagcatgggccttctccatatcgaaggcccaataaatatttgtagaataaaggaattcacaccc

SEQ ID NO: 174 - DNA, 2070 bp, Homo sapiens
attcagctggcgcgctgcttcctatctttgtaagggaagagctaagtgcagacaaagccctgacgaatagaggcctgcgcagagtgcccggggtgcagggcagcagggcagccagtgaaccactgagctcgcactgtagccagtcctgtgtgcccctgctggattctgcttctatgagggaggcagcaaggagttgggacttcacaggtgaaaggacttgccaggttttgttcaggtttagcacaagctgtgatgaatatcttcaagcctctgcttcctgctgtggaattgttgccaaaggacacattcccagatgggattactgagtcagaggaagtggacattgagtggctctcaacagacaggctgtgttgctctcacagtgcccagcttcccatgggtggccagccgaatgcattatgggagaaagcaggtctcgtggataatatttctgaagatcggagcaggttgccaggtccacgtcggccatgactgcagcacgctccggaggcagcagggggcaccctggagcttcgcatcctccttcaggcccgcggcatctcccctggctccaccatccccaggtgtctcaggcctgtttcctcctcatgagaggtggagcggtggttcccaaacacgatgtgggaagtgtgttaaaatgcagatcctgggctcgaccctgaagctcttccggcatccaccttcccaggtgaccagactctggggaaggcatcacctcaagactcctgcacccttcctccagagtcctgggattcagctaaatcctgggaaggtgcctgcctccctgctgcgcctggccacgtggaaacccctgtagctccctggctgtgcaggagcagccacagtgtgcccctcccaggaccaccatccccctcactgtctctgaggcacctgcgtggaccgggtctggattgagtctcatttctctggattcccacggcagccggcggctgcctctcccacacccgtcactctgtgtcatggaaagctgtgtgtttgtcttcattcccaccgagtctgagccactcgaggtcagggccatgaccgtgagctgcacgtccttggcgcccagtgtgagccgtgtacagtagaggctgactgacgtcttggaggcagaagtcctgatccctgactgccatctggacttggaggcggggttggggaggatcctgctcctggagggagagggatgtggagtggagaaaatctcagccaccaggaagacaaatgggaggacggagccttcccgccaggcaggtggtggggaggagtggggtggagccaggcggcacaggcagcagcccttgatgtgccaaggctggagcgtgaactggctcttgcaagaagaggtcctttgaggaccctgcggctccaggactttctgcagaagtgtgccactgagctgatggggggatgcgacttgggggacggaacgtcagctgccatgtcagtgccaggggcactaggctggcaagagagccaccatttctgcccaagcactagccaggggatgatggacattgtgacaaagaaacaaggacagttgggtgtgacagtgacaatgggctctctgtgtgccatgacatagcaggaaaggccaggccagacggactgtggatgtctgatggctttgagtgaactcaacaaccattgactaggtgaagaatgggaagggcaccagctgaatcctgaggaccatcatctgttgagcacctactgccaccgtgtgctctgcatgcatcacctcacttaattttcccagcagccatggccagtaaatgttattgtatcccatttgacaagtaggcaaactgaggctctgggagatgtagtaattttctttagttcatgcagccgtgccttacacaaggggtgcaggatttgaattctgtgcttctgtaacagggatattatccctgtgaggccacctaataggaggcatgctgtcagaaaagaaaattctgaccaggctactggcctcttttctttctttctttttcttttctttctttttttaaaaaacaaaacaaaacaaaacaaaacaaagcc

SEQ ID NO: 175 - DNA, 2005 bp, Homo sapiens
cttgtgcgaggcactctaaccggagactgaaggtatagagcaagcttgtccaacccgtggctcactaaccgcgtgcggcccaggacagctttgaatgccgcccaacacaaatttgtaaatgttcttaaaacattatgagaggttttttttttgcgctttttttttttttctcatcagctatcattagagttagtgtattttatgtgtggcccaagacagttctcccagtgtggctcagggaagccaaaagatcggacgcatggtatagagaaaaacaagaagcatccctccatagcgtatgccccacaagagacaatttcccagagaccagtagctgaggcaggtgtaggaagtgaatgggccattagatggatgcctgtggaagctaaagaaggcggatcggaggaagacaatccgacctggggagtggaggagagagggggagaaggtggcatcgacttggattttttaagattgagtcatttggggcacttggaaatgggcattctgggtagaaggttcagtattaacaaaaacaaaacaatactcttgagtgggaagaataatggatagtttgatttgcctagaatgtagagattaataaggatgccaggattctagggcgggggaccaagatggggagtcagtggtgggaagccctggaagattccaagcaaggcatgacagtgctgtggcagcggatagttaatttggccaaggagtggaaccctcctttgtagcgtgagagtgttggaccaaggatctttgcagcactgagagtctatgaattagccaatctgggaatacagggcttcatggaaacatcacagtgtaggaggattatggatggaaagtgcagctggaatgggaaaaggtcgaaacctaattagaagccttgggccaggggtagcctgtgatcacctgcgattgtgtttcagacttccagtaacattcttgggagtagttgttaaaaaagtgctcttcgtgtttctgtaacttgggtggcctcttaggcatgagcagacgttcagcctgtccctatcggcagggaacatttatttattttgatgcatccccagggaccaacagagagctataaagacagcagcctgttttgccagttggccagttgaaatgggaaatttcttatacaaagattacagacttaaccttcatgccactctttattataaactgttcatacagttctttgcagatggactcaaaatgcagcatttttttaccttaaagattgtagtagaggatgttataaatgtgtctttaattggttctgtgttttctcatacttatgaagcactgcattacacaatttgtctgaatgaaattggtagatgtggtccatgtaaaacttacccaatcagacaggttacagatatttgcctaaaatctgagcctgggcaccttagagatattctaacctcacccggaaactccgcaactggaaaggtgcagggattctggagcgaggttccacttcacattatcttctggttctgcatatgaatatttaaaaacttcctgtggtgttatatgaaatatgtatttgcatgcttttgcagctgctccatctaatagtatttgagaaggggaaaaaatgaaatgttgcttagtagaaattcctttggttaatgatgttaatcaatggtataaaaaaggagcatgaactctggaataagaagggacacctgaaattgaattccagttgtgtcgcttactacctgtgcgactttaggtctggcacttaactcatctgagtctcagtttcctcatctgtaaaatggtcaccacaataatcagctcgcagtctaacagaacaacctgtcaccactagaatcccacttgttggccttttatagccacacctacttccctcccactgcctcctccacttccttaactcatagcaaccactgtgtgttcactatctttttaaataattgtatcatttcaagaatgttataaaaatggaatgatatagtgtgtg

SEQ ID NO: 176 - DNA, 2544 bp, Homo sapiens
agtgtgtgggtgtcactgtcttcccatcaacccgtaaatgtgatcacatacatgggtgtatgtgttgccgtgagtgtgagcgtacaagggcgggtgtggccgtgtgcacacgtgtgtgccttcacttcacagagtgggcgaccccatgactgtgctcgtgtgtgtgtgtgtgtgactctgagctgagctgtgacccagcgtgtaggtgtgaacatgggggctctgggaagccatgtggatgtgtctgtgtgtccccacacaggcctgccctccccaacccctcccctcccagcatgtagaggggccccctgagctgctggtgctgctgggcctggtgctggggtttgtgtgtgaaggaggggtggacgcgggcagaacgtgggtgcctcagctccgggcttggcgggttgaggagagctcggaagggtgggcccggcagcgtccccggggctgtgcagatgttacccgtgcctggctcggcaccaaggctgggccctcctgacgccagcccatctgacctgcacctccaatccatgccctcagccctgcatcccccatcagagagccacctgcccggacccacgtcctctgactgtcccccgccccgtgccctctgcccccaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcccggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttccagct

SEQ ID NO: 177 - DNA, 2030 bp, Homo sapiens
atagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttctgagggctgtcactgggcaggccatatacaaatcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaaattaatgctgtattctcctagctattatggaaacttgtttaaataaagatatggatat

SEQ ID NO: 178 - DNA, 2652 bp, Homo sapiens
tgtttccgtctgatcctctctccatctccacagccctagtttgctgtcgtcatctgcccacaagttttaaataactcttgttttgaaataatgtgactcccaagaagttgtaaaaatagtccacagttccatggacccttcaggcagctccccgccagcggcaacgtcttacgtaaccacagagcgccggcaacacctgctgccagtggtgacgagagtcactgtgcgtgctgtggcgctgggggctccacacacaccttgtttgtgtctcacgagtggcacgtggttcctttcaataccttcacggcctttgccctgtgccacgcactgtccaattgcttcccctctgtggactcattaatccaaacagctgccctgtgagccaagtccggctgtcatccccacttggcaggtggggacgctaaggcacagagaggttaagtatcttgtccaatgtcacacagctagtaaatggaaaagctgggattctgaacccaggcagtctgggcgtggagtccgagcgctgaccacatcagaccacatgtgcagcattgcagtctgcttgccctggacaccacgcagcctcctgtctggtcccccggctccaaaaccatctctgcatatagagtttcccaggatagagcaagtgaaactgcgtaaggggcagagtgctgtggccatctggcccccactagtgtggaatgtgcaccccacccccacatggctgaacgcacacgtgcacctgtagacacgtcttcatttgaaatgccagtctctgagtgggcagagactgcctgtgggtaggggcctggcagtcagcagaaggcatggacagcatagatatttttctctgcatcttttatatacctgtgagtttgggtttctgggcatgaattacatgttcaggtaaaaatggaaataatacaaataggtcctggcccgccccggcctctcctcattctctttgcctccatccccagcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatac

SEQ ID NO: 179 - DNA, 2148 bp, Homo sapiens
agcaaggagatgacccagctgaacaatgcatttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtctcctctccaggtcgcccctccgtctcatgcgacaccccaatccccgcagcctctgctcagcgtgggaccaagaatcgggagtcctacccctcctcggctttccagccccctaacccaagacaagagggcgcgcgcctgggctgggacaggtcccagccgcattttcgtagattgcactccccgcccgggagcgacccgttccagcagcccccttcccgccccatcaacgcggccgcacggtcggcgtctagaggcgacatcctggcaaagacaggaatcaagtcagaaattcaggctctagaagcaaaggctgcggtgcctcctggctggaagaaaacggcgggtgggtggaggatgcggtgcgcgggaatttccccacggacgcttgctgtttcctgctcacctttcaggaaggtgcccctctacctgcaccctcccctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagcctcgacgcatatctcgagagtggcgggaggcaaagcagccggaatgcccgagaaaaaagtgggcgtcagaggcccttgtcctagcgactcccccaccgcaccgactgagtcccgggactgcagggatctaggcccttacctgtctcggcgcctcctttctgtgcgctctgcggctccggaagccggatcgagggtcacagtgtggttgggcgcaggcgggccgctcggttttcacctcgaggacccggacttgcacttgcagagccgctgcgtgggggatgtccctcttttttcctcgccccggcgggctcctccggcgtgtcagggtctctgggttccagctggagttggcgctccggccccacagctctttccagcgtctcggacctgtgcgccccgccccgcgctggactccgccccggggtccccgcctgcctcctagtccaggccaagggtggatgcccagctcccccaccccaccgcgtgctctcgggctggtgcgtccagggcgcgggcaccgtagctccggccgcgctgacgcgagtccccggcagcgggggcagcctctcgcacggatttcagcgccttcgcatcccgtctgaatcggaccacacagtagccgggtttctaccgtgcgcttgggaacagtgagcaccgccctctgccgccagtcgtggcaccgcacccgggtcgcgcgcgcaggaggggagagtcctgtcttccggaggtgcccagtgccagcgtccgcgcccactagaaggtgaccctttcaaggaaagcccggctccgacgagtgcggtgtgggcctttggagatggcggtgaaggaggaggcccccaggaggaagctggggatgggaacagtttgctctgctcaaagcccctgaagtcctcacccaaactttgcgatgaccaccactatcagattccatggccgtataaagacaatcccaggagtgcctcagcccatctgtccggagagtccggagcccttcactttgcttctgacaggttcgaaatcctcccacgaccttcctggttaaacacaggaactgcccattcaaatgactggtgcccaggaagctctgggcatacaggattgaacctgtggcaggaccctgaaggtctaaaaaggtgttccccatcgttaaaccccagccagcggattattggcaggtgggaacatggactccactttgtcagagcttcccattgttttcaagagaatctggaattcgagaactttaaaaatagtctttgggttcgttaaagcaaaaatcttgttttggtcaaagagaacctgtctcagactgaacacagtccacaaggctgccaattaaaaatttttggataaatgaacttcaaactcc

SEQ ID NO: 180 - DNA, 2024 bp, Homo sapiens
agtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggccacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttggcaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctc

SEQ ID NO: 181 - DNA, 2011 bp, Homo sapiens
agctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccactgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacggctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccaaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtccc

SEQ ID NO: 182 - DNA, 3266 bp, Homo sapiens
cataatgtttcctgaagcatgaaaggatccttgatcagaagagtgctcagttctaatttctaaaatttgctggcttaatatttttaaagatttaattctccatatgagtaagttagcgtgtatcatcaaaaactatctagaactgtgtgcagagactgttactggttttccaagttatatatttttgagtatcttaaaatatttcatcaactttctaaaacatcaagaaaagctctctatacaaataccatggttgattttaattattttgttttccatccttttaaaaatattttctgctttgcatcccattattattttgagtttcttttcatttgtagtttgttgttcattgtgttgttttacagctaagattcatttcatacgtttgatgcttagctgaaaaattacaataaattctccaatgaaattatgtatctttatttaatgaaaatgcctgctgcgtaccaaggtatgtactagggcatctggggtaagtaaaaacaaacacatagagcctgcctggagaagctcatggtctgatggaaagataagcaaggagagttaatttctaatcaatatgataaaaaggtcagagagcagtttctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagtactccactgcacatgctaatgacttcctctgacagccacacaccgaatcttgatgaaaaaagagaagagcatttgccttgttacatagtctgttacaagccagatatgttgctagctctcaagagttgtaatatattaagaactacaacttatttgattaaaactcagctgtatagatccttttataaagcaccttttgttaaacatcagcctttcattggtattttaaaagcaaggcagatagatatgaagtcagccaactctgacatgcgtcctttcttatctcccttacctgacactaggggctctagagaggcagagagagcactcacaaatcacactaaaactgccagcggcctgactcttactcagtttagcaaaaattcttgcctaaaaagtgataagtaaaaatctgtttatggtatacagttatgtctcgaatctttgaatcaaatccatgttcttattttagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatgcttaacttcccaagtgttctgcattgaaccacttagggaaaattttgtttgtttttatgttttgtaatttttaaaattaagtaaagactggatcaaaat

SEQ ID NO: 183 - DNA, 3411 bp, Homo sapiens
tatttattgagacagggtctcactctgttgcccaggctggagtgcggtggtgtgatcttggctcacagcaacctccgcctcccaggttcaagtgattctccagtctcagcctccaaagtggctgggactgcaggtgcacaccgccatgcctggctggtttttgtatttttggtggagacggggtttcgccatgttggtcgggctggtctcaaactcctgacctcagttgatccacccacctttgcctcccaaggtgctgggattgcaggcgtgagccactgcacccagccaattttgcattcattcagcattgtttctaagatttatctgtattgacgtttataactttattgattttttcattgctccatagtattttattatatggcagtggtaccgtttatctttttctcctattgatgattttatttattttttttctccagttactgattcttttgagtgtttccagtacatggtctttgtatatatgtgcaagatgtttcctattccagattctaggaataaacttgcatagactgtaggatatacacttctttggctttacttgatattgcagaattcttttctgggctggttttttcatcactagctctttagccactctttagatcaatgacttgtgggttttttatcccttggaggtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggattttttaaacccagttggctttttaagaaagaaagaagttccgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggtttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatt

SEQ ID NO: 184 - DNA, 2252 bp, Homo sapiens
gtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgcctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagtgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactat

SEQ ID NO: 185 - DNA, 3234 bp, Homo sapiens
acgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttctagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgttttttt

SEQ ID NO: 186 - DNA, 2538 bp, Homo sapiens
atcttggcaaaggggggatcaggaagtgcggaccgcggcggcgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttgtaagaataacatacttacaacaagtctagaatgttactttagcacagtgaaaacagtttttgaaagggtttgttcatgattacataattgatgaaatattatagttttctgtatagagttctaaatgctaattctgatatcactgaatattaattttaagatctcaaattgtttgcaaatcttttatatctgattatagagcttgaatggccctgtctttattagcttgttgtgtttagtagtttataagcagccacttggagaatggctagtaaagttaaaaatatagagaaagacagttgatatatgtagcttgggaaaaaagaacctcaccctcacccctcctcctacgtcctcattgtacactattttaggagacaacatggtaatattttgttctgctagggaagatagcagagttgacacgcagtactccctttagaattcaagtattcctccactctcttgccaaacttaatcgtctctcctatgcagaaggagtcaaagcagtgacagggtgcggggatgtttacaagtcgtgagagggaggatatcagctgtgacattgagactctgttccaatgcagggttaatttgctgttcattttagcatttacagccagacaagatgaaaagcaagcaggaatgcctattatatttctattaaatgaatctgttgggacctaatgttcttgattagcttttgaaaatgagtgctctgcaatgcattttctgtttacctaaagtaaacagagaatgaattgtcatttatttagagattcaaacactccttttgaaaatgaagctttatgagggatctagctatgttgtccctaaatgttcttttcttttcaattgcattaaagcaaaacatttgctccaactaagtgaaaacactgaaagagaatgaggatgctcagttgttacattttgaggtagtctaatttctgtttagttttttggccgaccagctctgccaggtctctgcattaggaaatcccacatgtaacagtctttggatttagctctgataccaactgttcattaaaaacaaagtgtccaaagagcagaagagacaaaaattcagttcttacccattctagccgcagtagctacatgttgacagcaagaacctccttttccccctccacagtctgcacagttacaattacactacttattctgtgtgtgtagtcccttgaccaacagatccacaggcaaatttgctgcttataaatgtaatttttttctgaaattttaacttaacttatgttttatcttaggactcttaaacttccaggactgctagcattacctattctgaggaaactctttttgttcatttcggttttaatgtgtctctgtaactatgattattcagcagaagaccacagaggcccttatgctgtgttttggtatcagaatgctttggggtagcttacttctttttagagaaatttgcaaaagtaacatgccatatttaatttttgtctatttgttggaaaaatgaacatgcttgagtcctggttgtggtcagtttatactggaggaagcaaaacatatatgtgaacatcgtttttagctgtctttagagaaaatagatgttttgtcattgctgtgcttaaacacattgttgtgttggcagtagttttgagcaatttggtacaatcttcgtccttccagtcactgttagaaatgctttattttggtcagtatactttcctgtgataaaagaaaaggaataaaaagaaaacataagt

SEQ ID NO: 187 - DNA, 3076 bp, Homo sapiens
ttgttgtatctttttgtttagaaaaaaataatcacctaatcttttctaagagcagcatgtgtttttcccccagatgctttttatctacagaactatccctgtccagaaattgccttagatgcttgataattcgttttgtgtttgagattttattttgaagttactttattggatgaaatatagttcttttttacatagtttacattgcttcattttcttccagtattctggattcagagtttatttctaaatgtattgaattgtgttatcagaagtgcttagctaatgatacttttttgatttttttctccttatttctaatgtaatttccctccatgcccctcccatttctaaaacccctaattttgagactgtctaaactacatgatacatataatcctaatctttattataatataaatgaaatctttaaaaagtacttctccaaaaattctttttctgttcacagaagtggggatttttttggtgtttgctttgtttcagaaagttctttcttccctttccctacttataataaatattattgtatagatgttactgctcaagttagtgttatgatatcaatgacttacagtgagccatgatatataaaatgacagatttaaagattaaagctccttgtacttttaaaaacaaagaatcacagtctttctttaaagacacactttaaaaagagtgtcacactcctttatttctgtaaggatgagtattggtggggtatggagaggtgagtggatatctatttcagatagttttcagcatgagtcattgatttcacagcacatccagatgatcaagagtggtgccaatcattgttaaagaaaagttgttttgtttttttaaatgaatagagttgactatgtggcaaacgaatatttctgtattctttgcttcagcagtgctgaagagttggaattataaatataacacagtatgttattaattcacaggaaatcttagcaaatgcagctgtgaattaaaatgtagtttaaggaatagaaagcaaggaaatattaattgaatccattcatttgcttagtattttatgtagaaaatttaagagtattgtataccctttgagaattaattctgtatatcagcagaactctgtttaggtggtattaaatgcatttgctgctgctttcaaaaaaaatttgttttccttttggatttataaattgttcatccaagatgcagaaatagtcttattccctgctgatttggtacacttaatgattaaatgttataattttaatactaatgtctatattatagggggaaacttgcaccctgggtggtgataggatttttcctaatctatacaaaatatgaatctgtccatttttcttacaatacaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttatttttctttttctgattaaacgtctgatgcatatcatttttctataagtaatcagttgcttttaaaatcagaaggctatattattctaatgaccctattcgatctaaatgggtttgagaatccatatcagcaacatacgtgtttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtggttttagctttagaaagaaatgcgttatagaaacaagtaatagcaagaaaattgatgtatattttaatgatacattaaaattcccttttaatcat

SEQ ID NO: 188 - DNA, 2070 bp, Homo sapiens
aaaggagaggggtgggagcggggtgggggcatcgcgacccagggcaaggcggcgagtcgccgtcttcgagtcccacctgtccgaagcggggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgactatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgagatcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggatttcttgagcccaggggtttgaggctgcagtgagccacagtcacgccactgcattctatcctgggcaacagatggagaccttgtctcaaaaaaaaaaaaaaattcctgacatcgctatgtattcccaactttatcatttgtctgcctgtttagttttgacttatgtttttttttttttccccctgtggacatgtagttgacggaaatcgtgaaggaactttaatattttatttaaatttcccaaaactaatcatgccttatgtgactaatcttcagtgataatatttcatctactgatatattttcttgaggtgtgtaattttcagtataccttaatcatttggtataaaaaagagagaggtttttgatatatgaatgctgttcttgtaaaaatcaatcttgacactttattttaaactttttattggtaatgacagtgggttttgtacatcatgattttcaatttaggatatctgtctaatttgttttttcagagtaactatattggaattcaataaaaatattcaaaatttttctt

SEQ ID NO: 189 - DNA, 2408 bp, Homo sapiens
aaaaaaaaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctcccttcctcttttgtcctgaattacttaggtgactgatttgaatggcattgatgaaacttcccctgtgatgcaatcagcaaatggaaaatttgctctatgtgaatccaatttttaaatcacaatatgctaggatgtcttcctactgtcctatatctttaagcctctttcctatgtgagtgaatataaatcaaatcctgtagaatcactgttttgaacaggtgacaagatcatgtatgtgctaatgtagtctcttggagtacattgataagtcgttccattaaatgttctattttgacgcataaccccaagatttgaacatacacacgttaaccaataattgaattaacttctcttgtaaaaacaagaggagaaatggcagatcgtatttcagtgtagccaaggaaattttaatgtattgaagaaaacatagtttaatctgaaatcttgatggtttatttgaaaataattttatgttgaaacatcttagtatgtatatgtagtatttgtatttgtataatggaacaggaagagaaaggcactgtgtcataagtaattattgaattacctagtctgtttttcttaagaatgcccctaaaaaggggaaaacttaatgaataacaagtaataaggtgtggattttgacagtatcatattctcttaaccttaaacttgccctcttttcataaatgatattgacattttagaacgtcatagtctaatatagttaacgggttttgttttgtgaagattttgcctgatgtatttgttatatattattagagatactattttaattgttcattaacaaatcaaaatgatgatagttcatcctttcaaaaggacaaattgtctcactatgttaattttctaaaacatatttgcctacaaagctggctgaacaaacacccttttcatatgctatcataggctaagaaggtttcttagaaggggcagtaattatacattctgtaaaccaattaccagcttaagtgtagaaataattttacatagtagtctaatttagctgatcattactgtgtgttagacatgtcattgacacacactcatgccttcgtcacataatcaaagtatgagagcattttggtcattagagtagcggccagtagagtaagatgaatgtctgggaaaccgtcatggtgtaaattgaatgctctgtattagaattatctgtctgttggaaaagtagaccgtttgctaccacgttttctaggtccaggcaaatttgggtagaactcttcttaaaagcatactgattgttaacaaaagcaattttatctgggaagggtgatttgtttggtgagaacttagcacaaactgttattttctattgacttgtgatttttttgttgttggatacggaatggggtacatggatgtgtgggagggaggaaagggaaggggtggggcatgggctgggcaaggatggggtggagggaacgccagactgttcgccagtaccttggatgatggtgtgaaaaaatattatcttctgctgtcatctgtttccatgagaaccttaaaataaagttt

SEQ ID NO: 190 - DNA, 2491 bp, Homo sapiens
tgttactgttaactttcaatcatgttatgcatcataacgttttttgtttaatgaacagatatgagcaaaggacgttaatcccggtatcttctctagttgtagttgtgtgtggttctcgagtggctgcgcatgtgaacacgtgtgatttctcagtgtactgtactgtgatttgtttttattgcttgttttgtttcccctcagtgtctgtaacccttagcaggctctgacctagtcaggctagaagaagcataaggatcttttattgctttgtgctgggtgagggctggccctaaacatctgcctaatcctttcaacgggcccaggaaaagccagactggcatcatgtccacagcatcgcttaatatcgttggttgtcatccagacacctcaatttgtgctgcagaggaaataagttccttctcacggatcatcatgatggatattgaaacctcagggtgcagaactaacacctgttcatcatcgtggatgttaaagaattgggtaacatgccaagcggtaagccttggatgggccatgagaatatcctctaaaaagcacgcagtattgtgcccctctcacaaccaacacacacgtgacctgtcccctggcacccccaaatttaagagtggattgcaaatcttttggagaccatggccctgctacatgtagaaaaacctgttctgctattcctgggcccacaataaacccagaaattatgttttgagttactgtgatttaaactccctctcttcttaaatggaacagctcattggggctttctggatctgtttccatttttctttaaaaataaattgtgagcatgcattgtggtgatgcagaggcaggcattctgtgagatacaagctccagaaggattctcctcaatgtgtcagtgttgggatgcacacttcctaaataaatcatcattgtctccgtcttctccattaatagcgctctttcagtgtgacatggaaaagcaggatggcatacaccccactgaaggatgtaggcggaggcagatctctcaaccaggcatattgcttctgtactgctcttcttttgctctaaggtatgggttccctcaacctcttagctagagaccagcaaatgtcagggaagcacccggtgtctggctccccttccaaatcaacaccagtgtcttgttacagacaagaagtcagaggaaagggcggggtcccagcagggcagaagcctaagctactatgaggcactcacaagtggcagctcctgttactccctcttaaattatgtgggaaatcttaacggaagggcaatgggccccaggaatacctgcagcgtagtgacctcagatcctgatactcaccatgaaactctaagatactgattggaagcgacttgtggctgctggctgtgtgtgtgactctgccggggaccctggcagcccccctgtagctgtcttgatgcctctctgtcacccacatcatctgcctacttaacgcccagctctgctcagaaaacgttatgtcctgtgtcgaggagagacgacgcaaaattctgaagtccatttccctctggctcctggcataccctcgctccttttctgagcccagctcgtggtgtgccagagcctgtgtggtcccctgacttctgcacagtgtagaactttctccaatagtcacaatggcaaagggagaactggggggctggcaggtaattagaatttctctccctctctcttttaatactttcattttgaatgtcttatttgttcatgtgtatgttttaacttaaaaaattctttctgatatttttaattttgtgtcataagaatgttttcctctacagtatttgtcataccagtttataaccacagaaatgcagagattttatttctattggaaacattactacagctatgttttacttttgaacagaatttttacttgtatagggtgcttactaatgttaaatagtttggagtatataacatttacattaaggactcatggtaggttaaaaccctaaagggtaaggggtttaaaggaaataaatattcaaactgagtcttattgccaattttggtgtaaatgagtttgtgtcatttcaattacaaagataaaagtatgccatataatttatgtaaaatttgtttttgtggtgtacataatagttatcaagtctgttgacagaagtatattttaaaagaatatacatgtgatgaatccataatatctgaaactttgctgagatatgagtggggcacacttcattgtaaattacagcaaggaaagaaattaaggaaagaagttaagagagtgagagtgagtggatattcacacaattgttaaatgtttattagttaccttttgtgatgtagtgtggttctcattttaaaccttggaaggtgaaaatgtacaaactataaatatgaatgttcaaacactgacagaaattctaatatgaattaaaaaataacgaaaaaacaacaatatattttatcttactaatt

SEQ ID NO: 191 - DNA, 3090 bp, Homo sapiens
atgcgcaatggagggtccggcgtccgccttggcgggtgggagtgatgacccgcactccccaaaccactgcgggatagaacggggccgagtgctctcaggggtggccgctaccggggcggcccgagacacggctgcgggttccagccaacaggcccggagtcgcggcctcggctccgccgtgggtgcacgggctagggctgcggggactcctgtgggctccgcgtctgcggctgggaggaatggggatcgtccccagatcccgccttccgggcagggcctccgctgcctgcgatcctgcccacagtccaaggatcctcctcgcctctcgcggactgcggtgtcagccgcccgagccgttccccggacacctggccagggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaactttttttttttttcggacagagtctcactgtgcagtggcatgatctccactcacagcgacctctgcctcccaggagaattgcttgggcctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttgggg

SEQ ID NO: 192 - DNA, 2514 bp, Homo sapiens
gtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatggtcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcaactggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatttgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagag

SEQ ID NO: 193 - DNA, 2552 bp, Homo sapiens
gtgggtcccggattagcggcggcatgggacggttgagttggcaggtggcggccgcggcggctgtgggcctggctctgactctggaggcgctgccttgggtgctgcgctggctgcggtccaggcggcggcggccgcggcgcgaggcgctgttcttcccgtctcaggtgacctgtaccgaggccctgctgcgggctccgggcgcggagctggccgagctccccgagggctgcccgtgcggcctgccccacggcgagagcgcgctaagccgcctgctgcgtgccctgctggccgcccgcgccagcctggatctctgcctgttcgccttctccagcccgcagctgggccgcgccgtgcagttgctgcaccagcgtggggtgcgagtgcgggtcgtcaccgactgcgactacatggccctcaacggctcgcaaatcggtctgctgcgcaaggcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttccaggtcgatcccattcccttccctgattctagaaaagtccctcctgctttggctgatgtgggccctttcagcatctccctgagatttcatccttctctccatgtggcacgactggggttggttggggcctacagtctccttgtccctcacagtctgcccctgtcagggctcggtcctcagagtaaggaaaggaaatggaagtcaggaggaagggaagatgtgagtgtgcggtgcgggtggcaaaagcagccttcggggcaaccccgtgagcgtcattgccaccaaaggctggctgttcccttgattccttgcataattgctctttaaaaccagtatgcacgccagtgccaagctcttcagcagcctgtccttgggtagtaagtgctgtggtctgtcaggactgatggccagcagctgtttctatgttgggcttttaactttttttattttatttatttatttatttatcttttttgagatggagtctcactctgtggcccaggctggagtgcagtggcgcaacctcggctcactgcatcctctgcctcctgggttcaaacgattgtcctgcctcagcctcccgagtagctgggattacaggtgcctgccacaacacctggctgattttttttttggtatttttagtagagacagggtttcaccatgttggttaggctggtctcaaactcctgacctcaagtgatccaccacttccgcctcccaaagtgctgggattacaggtgtgagccgccatgcccggccgggcttttaacttttaatgtcctaatgttaaggtaattttgttgtgtgtttagaagtgaccttacctttaacacctgtggagttagtgcgtgcacattgctggctcagcgtaacccatcacgggaccggaggagaggagagcggggaagaggagagcagcttcaggccgtggtgtctcccacgtctgtgttcttatttgcagctcagggtttgcattcccaggtagaacaggtgtcgtacactgtgaaatgttccaggttatttgtttataatgtgtgtgtcatatacagatagctccaatgacatctgaagttgtgacttcatcatcttgtcatatttctgtatgatgagccccagggcccatcctgaggtctgctagccatgtgcttagtctcacctccccagcccacgctggcattaccacccagagacccttcagtgctgtgtgtttttcctttttagggttacttttgactcacagtgttaggcaagccagcttggaagttaacttttaaaaaaattcaattgaagctgtaaagtataatatatagattggaagtcaccagaaattgttttagtttgtgaattcccccagtgtatgttctgaaaagaaaatgggagagcttgtaaagcatctcctaaatgcgaagccgcgtgaccctggacttctggcacatctgaataaacatgttcttattctgg

SEQ ID NO: 194 - DNA, 2494 bp, Homo sapiens
ttgaacatttttggtaggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataacactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgagctagaaagaatattgatttttaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgtttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttctgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatc

SEQ ID NO: 195 - DNA, 2116 bp, Homo sapiens
aatttaagacacttaccaaatgggtgtctcgcaacaattggctccgatttcaggccttcccctacaccatatttattttcggcactgaccctgaaggtatattccatgccctcatgaagtctggttactctaaaggtggttttctggacagctgaggcgcacgtcacccacttgttgttcacagaatccctcttctctaggatatagttggtgatttcagaacctccatcatcctttggaggagcccactttaaggtcatggcttctgctgtgacttcatcaaatttgattggtccagtggggatgccaggcttgccaacaacctttatggagatagttccttccttggtgccagcaacattcttaagtgtgattgtgtattttccagcatcagatttttggcaatcgtacactataagagttgtgttaaccgcagatgactcaacactgactctagtgtcagttgctagaggatcttcccctttcttccaggagactgatggagctggcttgccttttatggggatcttaagccggaagttgctgttttctttagccaagtagcacaaatcaggtagaccctttaagtcaagatcaggagccactgtaaaatagcagagataaattactgttatttttaaggccaggcgattaactttttcaaatagttctagcttttaacggatttttagataagctagtgagtgggacacaagagtgcactttcgatgacaataaaggaaaaatgaagatgtgtgcatagagccttaccaacatcatcccttgccacaacagtgatttcgcttggggttccttctccattttcattctcagcactcactctgaaggtatattccttcccttcagtcaaatcttttgcagagtactgtaggcttaaggatttcataactcgttgccacttattttcttcagtcaggaaatcaactacatatccaataatccgacttccaccatcactgtgaggctttttccagccaatgctacaggatgacttagatacagacctcactttcaggtccacaactggtccaggagtttctaaagcaaaggagaaatgataagtgtaagccccatataacaaaggaaggatataactcaaaatgatgggatgatggttcatttgcttacgggaagctttgacagcatcacgagtttcaccgggatcaccaatgccatactcattttcagcaaacactcggaagaagtaggattttccctcctccaaattaggtactctgaagcttgttttggagcactcagttgtcactgtagaccaggatttcctctctgcatcacgtttttgtaccacatagtttatgatggggcttccgccatcaataatgggaggctcccaggtaacataagcagagtctttggatatttccttaacagtcacattgacaggtggcccaggagtatctggataaatagtaggtaaataagaaatgaatgtgtaaaaaatacataagctattttaaaatatatatgattcttttttgaaatagacttaccaagcactttcacaacaatggtatattcctttttaccacagctgttctccagggttaagatatattttcctgcatcatatttgttcacattttcacagcgcaagaaagtgtcaaagtcagttgactttatgtccagtccaatcctgtctcttagattgacatttggtttagaccaagtaatctttggaggtgggcgtccttttactggtacatatagtctcatagtaactccagcacgtaatatgagtgtcttccttaagtccgcatcaagttctccctcaggtggaactgtttaattttgggtgaagaagttaaataaaaatttaatagtcaaatgtatttccagggactggccttgtcactcctaaaatacatttattttctagagctgatttcttgttctttaaaacttccttaatacaatcctcaaaatcatttttctgttctgtactaattgttgatctttccattttccactatgctttaggcttaaccaggttttcccccggaggatctgtacctcctctttcatgagccttatgtactctgaaatgctacatatattaaaaggaaagtagacgatt

SEQ ID NO: 196 - DNA, 2064 bp, Homo sapiens
actgcggctatgagagcaccatgggtacgggagcaccgtgggtatgggagggtacgggagcactgcggctatgagagcaccgcgggtacagaagcactgtgggagttagcagcctggaaccgtggatgaaaacccgtgtgtgtgggatgcggatacacttacacacatgtaaaatagtattgggggtgctgtgtgggcgagatgggagccggggtcatggtcctttgcctgcatacttctccttggctgcggaacttggaacgtgtctcagggatcccaggaggtgcaggtgttctacctctgagtttgccctgctccctgggtgagtgccaagcccctgtgagatcacctgggctaacttctgcttttataaacctcaggtgtggctggggacgggatgtcacaggcaccccatctccccatcgggccacaggaggcttggcctctgtccctgccgggagggccgggcagaagacgggcgacccacacagctggcacgttgtgagggcttggatggagtcctgaggctgagggagatggagcagtctctgcggaggaagtaggcagcgaggtcagccagcttcaagtgcgggaccgctgagaccctgtgcatcctcgtcaggaacggggaccaggagcagcagcgtcgggtcggctcggagtgatggagtgtgtggttgtagttacggtaatgagcgccccggagagtctgtgcactgaggccctggcctggccccggggggatggggaggggacagggcgggccctggggggatgcggagggggtggggctggccccgcccgtgctgccgggagcttcagccctccccaggcccagttcatccggtctgcgcttttaagagtgaccatcgggcggttttcccactggaacacataaggcgtttgctgctagaacgcacagccagcctgaccccatgcctgccagccaggcaaagtctggggtctgcttgtggggacgttgcctctgcatggcctgagggaaggttttgggagggttctcactaaacgggaaagggaacaggaccactccaggcccagcctttgtgccgcacgtccttatttctgctgctctgacgccgcgtttcaccttggccctgggttttagtatcacccgagtgtgaattctggaggcccagcagctgccttccacaacctgagacgccacctggcagcctgggcaaggcagggcctgcagggctagggccggcgacctgggggctgttcctgaggctccctctgggcagggctgagtctggagccggctccacttgcgcgtctgaagctccgtctctttgggcctgtgggccctgcccaccttcctcccttggcactgcagcctgtggggcacagggtccccacctctgccccccttgctgtgtggtcttctggcttctccgcatgggtccaggccaccgctccatggatcttcagccctccccggcctgggttccactcgctctccagacgcagcttgggcaagggggtggtgtctctcccctttgccacttcctgggtgctcctgtggtacctgcctgttcctccggggccacggcagccttggggtgggctggagtgaccccccacttcctgctgtcagaccaccccccatctggaggcaggtcagagacgtctcaggttcctttgtgctccgatctgcctgatgggggcgtcgtggtacccccagccctgtcaggagttgtgattcttgaagccattgtgggtagtggtttctgaatgcaggtttgatagatcatgtgtgcttcctgtataatctccagggtcgtgtttaagatgacgtatttaaaatgtgcacacacacgtacttaacagatacccaaaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagtgagactccgtctcaaat

SEQ ID NO: 197 - DNA, 2065 bp, Homo sapiens
agcagcttagggtgataggggaggcttcccaggagaccaggaagaggcttgggggtggcagccagcacagcccggtggagggcggcccggagacgcaccaggggacggatgcatgaacctgagacgtgtgagtcaagttgtgtgtgagcccgggatgcatgggagctggggtgcatgtgagcaggggtacatgggagctggggtgcgtgtgggcccggggtgcatgagtgagggtgcatgtgagcggaggtccgtgggagcctggggtgcgtgggaactgggtgagcagggtgtgtgagcggggtgcgtgtgggccggagtgcgtgtgagccgaagtgcgtgtgagcaggggtgcgtgtgagccgggagtgcatgtgagcctggggtgcatgggaaccggggtgagtgtcagcgggggtgggatccggggtgcatgtgagccagggtgtgtgtgagccagggtggatgtgtctggagtgtgcaggaccagaggccagctccgtggcagaagtgccaggggacatccctaattaagagaatctgtcctcactgggagcactgggcttggggcacagccccagggtgggcaggggtctgccagctctacaaagatgcccccacttcccgggggacctggccctgctatgggatgcaccagcagctgggggatgggctgtccagggtgctgactgtgaacgcggcgcccccacccacccctttggagaggtgtccctcgtaacattctggagcacaggagaggcctggacaggcaatggcccactcaatggtccctccagaccgtcgggcacaaggtcacacacaccatgtacagacaaggccatgcggaactgaggggcattcccgagcacacaggaaccccagcctgcccctgggctgtccccatatcctcccgcagttcccaggtcttgtggaggggcagacagggcaccagggggacccacaaacggcctgacaccatcactgccccaagaactgggcagagaagggatatggccctgggtccagatcaccaggtgatgagggcaggaggtcagagggaaacgaggccccaggagaggagatggccatcagcagctcagagtacatcctggcctcaagcgccaagcaaccccacaagtctcattccagacgaaatgcccaggctgggggtgaaggtccctgaactgaggggaggtgctagcacaacagagaaaactgtcatttaaaacccaaactggggccgggcgtggtggctcacacctgtaatcccagcactttggaaggccgaggtgggcagatcacgaggtcaggagatggagaccatcctggctaacacggggaaaccccgtctctactaagaaatacaaaaaattagctgggcgtggtggcaggcacctgtagtcgcagctactcaggaggctgaggcaggagaatggcgtgaacccaggaggcggagcttgcagtgagcagacatcatgccactgcactccagcctgggcgacagagtgagactccgtctcaaaaaaaaaaaaaaaaaaaaaaaacccaaactgcctgctccatctgcctctgccttccaaggacgcagacctctcctgtcatcaggaaaatgagctgttccaagctcccctcgccccatggggatgtgtcgaaggacacagggaggacatgtgcagagtgactggtgccatgccaggtgtgggaaaccccgttccatgggggctgggcaggaaggaaccctacacctccagccctgggcccctcccacaactgccccagccctggtgggaactgatttccctaattaacactccacgaaacatcctcacctccaccggagacggcaggaaagagacacccactgtcaccagacgggctcggtcacacacactgtgacagacaacagcccacgttgccacagacgcctcacaccatcacacgtggccacacgcgcgcgttaccgccctgcaacccggcgtcccccgggccccgaggccccagcgtgctggcagacccacacagataaaatgcgtgcacgtggttaataaaattacctgcaattttg

SEQ ID NO: 198 - DNA, 2118 bp, Homo sapiens
ctaactctgcaacagttatatttagacaaggataatcttcaccggctgccatccatcgctacacaaacaggctttgaaacactctgtagcctattttgtgttgtcttttgtaattgatgttttaatgagggttaggaaacttcagtgcaatatggaatgaagaacaatcattgtcattgtaataacaacagtaacacagccacagaaagtcaagtccccaccaagtgccgggctgctgcacttccaagcgctttacaaacatttttgggcttgtttttcacagcagcactgagaagtcaatccttctatgcctgttttacggataagactagtttggggctcaagctcaaagaaacccaccaaggaaggagcagagtagatcagggatttcaggatcctttaggccaatttggggtccctgtggccctccttggtttcactgcagatctccaaaccctggatgcctatgcatccacagctcagagaaattggcaggccccaaggtacagttcaccctttcccagcagctcagctcacccacagggccaaggaccccccaaaagaggacagtgggagtgaactgctgcaatagctcgtggcccaaaagccagattctccagcttggttcgtagttacattataggccattttattcctttatagtaagtagatcttttcattttatcagccatttttggatcaacatacttgtgtgatgtagtcatttaacagactcagaattaaccgcttaccaggcctgacaatgctcagatcaggtagtcatggtcatttttttaaaaaatggtttcaagtgttcctcaagaaaagtcaaaatggtttagaaatatttgaccagattatcccagtgctgagactgacagatgctcttgtaaacacccttcacccttctccaccgtctcgatataattaaataagttacagcaagtctcctttacttcccttgtgctccctttacagaatagaggtaattctccaaatacagaatgattttaaggattgtacaggagttcattccatctctaaagttaagcatccagaattatttcataattcattttcacagcatccctgtgttcagattgaaatatctcatttactccaggtcccacgaaccagagaacacccaggactcatctgaaggactctagtcaaccaatgcgtgtttacagttgctgagggggaaagaataagggtcaaattgctctatttaataaaatgtgtaatacagtgtcttccactgaaagggaactgaccctggcagtagctgatgaaaactggaatctgcattctgattccagatgtaaaaataatgtgagaaattaactttatatctaaaaaaaaagttaaactacttacccaaattacttgggaaatacaatattctgatgagaagagatgccattatacaccttatgaaaatttccagtgttgacagattgtcaacatctttacaggtaccacattaaaactatactgacggtggttttgtgtttctccttgttaatttgcagggcacttgtggatctatagacctcagggtcattgatatgtatggcttatggttgaaaattctctagaggaaagcatttagttacttggcttcggttcatttgagttacaaataagctagagtagacttctgtgtattcctttcttgatgagatgcaactttcaaccgagagggaaactggcactgatttctctgtggtaacccttgttctctgtgtcttttctggatacaacagttctgtggaagcaaatcattgaacgcaatggaggagtcctcaccagtgccttgaatgtcagctgcctggcgaaggtcactgacggcttcacccaaggacatatagtcgaagtggttaaaggcgtgttcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggc

SEQ ID NO: 199 - DNA, 2182 bp, Homo sapiens
gaccagagcggtggcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagtatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcactacggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcttctttatctctcattacactggaaatgttatttctgctgtatcatccgtgctcaacgttttagtctgtcaggctcaccttctctctggaaagaatttgcttaacttgacattccatgtgccgctaataaaatatattttg

SEQ ID NO: 200 - DNA, 2163 bp, Homo sapiens
agcccacactgcggagccaggcggcagcatggaccgggctggggcagacatgtgggccagcaccttcaccctggccatggccgagaggaagccccaggacgtctgggttctgctacctgagcacagcctggtcccgggatgcctggacggcggtggtgtccagtacctgctggtggggctctcgaggctccagtgcggtcactgtccggggacctgggactcggcccatgtgcacgtcctcttccacctgtggtgggacagggccagccaccgggggctggtgaagatgcgcatctggggccagcggtgcaggctgtgccccgcacccgaggactgccaggtgaggcccccgggcgagcagcccttcctcagcaggctggtcttgcacatcctgcaggactgctacggggatggccccggcccagcccggcaccccagggaggcctatgagggctgctgtgaggcctgtgagctgggggtctgcttcctccagaaggccccagaccccgcctggagcgccaacgccacaaaaggcaacttccccgccacggcctggggtggcactggcaccgtctccaggggcaaaccgctgtccacccctggcgacgaccttggcaagggtggcgttgtcatcgccatccccttctcccttgtgggtaccagcaatgaccaggtgcccatcgctgagggccctgccccccctgcgggggcctctctccctgtgactggcagctgtgaggccctggtcaccggccagggctccatcttcctgtctggggattcagtggccatgcctgggggcaaaggcttcccggtggccattggagaccccctcttccacggccccggcctcctcggcagcagcatccagaccttcgagctcaagggcttcctcttcaaaggccggggctccctctgcagcccggttggcgtggcccagggctggggccccatctccctcaacaatggcctcgtccctgtggggaaacacacgccaaccgtgttctactgtgtgggcctctcggccagcggggagggctccctcaccttcccctcctccctcaccagcatcttcaccaacaccctctcggagcccaccgatggccctgtggccactaaagaggcctccatcaccttccccttcatctttactgatgtcaaggatgccgttgctgaggtggctgaaggcaacgggaaggaaggaggcggccagggcctcgtcccagtgggtcacgacgccctgccagagaccaatgctggtggcctcccctcccaggtcaagggctcccttgccctccccttccctgctgatgtccaaggcaaagatgcctttactgacatcactgaaggcaaagagaaggaaggtggcctggtcaccgcgggtcacgacgcccctctggaggccaatgccgagggccccatcacggttagtgagggctgcatcaccatccccttcgcagtcttcgatgtcataaagcgcaagggcggtggccacgttgcctacggcccccagggcaatggctgcttctcccaaggctattaccagaagaggcagctgaggtccaggttccacaaggcccgctgtgggtgccgccgggaggaagacgagcgccctggccgtgcctgccgtaggccgcacgccgagccctacgaggacttctggatctgggtgtccatgaccgtgtgcgtcttctggctgatgtgcatgtgtcggctgaaccccgggatctacccgcagcaagtgtgacgccccgaagttcaggcaaccctcgcctctgggaccccgcctcgcctctgagacaccccccaaccccgcctttgagatgcccgccccgcctccgagaccccgcctccacctccgagacccctttctctgagacccccgcctctgaggccccgtcccccgcctccgagaccccgccctgcctctgagaccccgcctcacctctgagacaccccccaaccccacctttgagatgcccgccccgcctccgtggccctgcctccacctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaagcc

SEQ ID NO: 201 - DNA, 2217 bp, Homo sapiens
aggccacttggtccatgatggtggcctgctccaggctgccctcctccagctcccgcaggtacacttcgtagagctcttccaggcgctgcgggacggccaggttgtagtcgtcgatgatctgccgctggccctggataatctcgtcgcagagactgcggtgctgctccaggcggcgcacggcctcgtggcggtggcggagcgcaccgtcgcggagcagcgcgtgcgactgcatctcggtgttctccacctcgagctcgtgcacgcggcacagcaggctgagcacctcgcgctgctcctcggagccgatgcgccgcggcagcgtctcctccaggcgccggccccgcgcgcgcagctcccggcagcgctgctccagcgccagcttctgcttgcgcagttgcttctgctcgtccaccagggctgcaatgctctcccgggctgcggccacctcgggtggctccaggatgtctggttggtcatcacctgtgtctgagtccttctcgctgtcgtccttagcgtagcactcctttcgctgctcctcccgccatttgagggcccggcgggacttctcgtgcttccagccggcgatggtgagcgggtgtcgggaggtgtcaatctggacctccatggcgcggttctccagctccagcaggcgcctccgcacatccatctgctcctggaaggcgctggcgagctgctcccgaagctgtcccatgccagccttctcaccctgcccgctgtgcagctggacctcagcttggatgtggcggatatcaccccgatcctgccggccccgggcctggccccgcccagtctgctcatcaatcttgcgcttgagtcgctggatctcgccccgcaggtcagcgatgatgctggtgtactgggcgatgtggtaggagacgttcaggaggttctgcttcaccctagtcttaatgttcttggcccggccggcgtaggtcagggtgttccgggactcctcgaaggcactgctcgcaggactgatgtgagcgatcatcactgtgcggctgtttcctcccagagagtccttcaggagccgggtgagcttgctgtcgcgatagttgatgtacttgttgctacccttgtcgctcagggcgttgatgcagttgcccagtgccagcagtgagcggttgatgtgggccccctccttcatacgctgcccacgattctgtgtctgcgaggcgcgctctgagccagccaggtcgatcatgaacaggcggccctgccgcacctcctgcaagatgttcttgacccggctgcgctggcgcacggtcacctgcagtaccgcgtgggagcgggaggacgtctggttggcggccgtgggctcctgggtcctctgccggttccccttcatcagcagctgcatgatctccaggtaggacatggagacctcatactccatgtcattgctggtctcctcgatggcacggaagaggtcgttgagggtctgaacatagatgccaggctcctggtctgtgcccagcatggtgtaggttttcccacagcctgtggggccataggcaaagacagtggcattgtagcctgagatgacgccctcgatgaggctcttggtggtggcctgatacaccatctcctgggtggcggtgaagtcaaaggccacgtcgaacaggtaggacttctcccgggagcgatgcgcccgcaggatgtcgtcgggatcctccattgggtccatgagaaccaccatctgctcatccactttatgggcgatgagggtagctccttcctccagctctgccacgctgatgggccggacccgaagcgccaccatgagttgctggtccttggagtccccgctgtccttcatgattgcagcaggtggaggggctcaggccgcgccaccgggcatggctcagccgcacccccaccgcctccgggtcgcgtccgccagctgctagctgcccgccgcctcgcgcgctgcctgacaacccgaaaccaacaacggcaggaggctcccctaaggtcaggagttcgagaccaccctgggcgacataacaagattccatcgctacaaaaaattaaaataaaaaattagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagt

SEQ ID NO: 202 - DNA, 2342 bp, Homo sapiens
cataatgaccctctttgataacgtgtttatgctaataagatagcttggagtggggtccatagatagtctaaaaactgggggggaaggagctgaagatcatgctctgtaagattcgtttttcttttttttaatatttaaagagatggggtctctatgttgcccaggcgggtcttgaactggctaatttttatatttttagtacagaccgagttttgccatgttggccaggctggtctcgaactcctgacttcaggtgatccacccgtctcggcctcccaaggtgctgggattgcaggtgtaagccaccgcacccggccttattttgtatttttgtagagatggagtctggcaaacatataattaccaatttattgctcttctgtttgaaagaagtgttttgactgcagtaaagttctagcctattgtgaaaatcaggctaacccatttctcagatggctgcctggctagacaccctctctgagatggctggaatgattagtagaaaggagtgggcaggaagtaggtggagagtggggattctagatcaggggtcctatggcctgttaagaacgggccattacagcaggaggtgagtggcgggcaagcaagcattaccacctgagctccgtctcccgtcagatcagtggcggcattagattctcctggaagtgcaaatcctactgtgaactgtgcatgcaagggatctaggttacgagctccttgtgagaatctaatgcctgatgatctgagatggaacagtttcatcccaaaaccattccccctaactcctcccccattttttcatggaaaaattgtcttccatgaaacgggttcctggtgccaggaaggttgggtaccactattgtagataatttccttccaaattactggcatctgggttaattctggcagtatggtcagtacaacatggacgaggacttgataaagtgatttctttccacccacccaatatcttgttcttctccaggcagtcagttgtgggaaacttatcaggtttgagggagttacttgctttcatcaggtcaccttgtcccctacctcagggagccccacagctctgagtgctttggctgtgggagaattccatcctctgggtgtgcaagtgggtgtgtatgggtggaggaatctgaccaaataaggctttaccttagctagaaaatcaccctggcttcaggaaacccaccagtgcatgccagctttgcagttcttttgttgttgttgtttttgggacagagtctcgctctgtcacccaggctggagtgcatttgctcaatcttggcatttgcaacctccacttcccaggtacaagtgattctcgtgcctcagtctgccaagtagctggaattacaggtgcccgccaccatgcctggctaatttttgcattttttagtttgagacggggtttcaccaatgttggccaggctgatcttgaactcctgacctcaagtcatccacccgcctcagcctcccaaagtgctaggattacaggcatgaggcacagtgcccggcctcagtttctgcagttcttgctttttaacagttgtttaccctacaaaaatggaaaatatacttggaaatattcgtggacatagggcttttaagtatatgcacttagagatagatacagacaacctatggattaggaaataggacactatccatgtctgaaatttaaataaggtccaaattagcttagatccaatatgattccccaatgcatatatgaacaatacgtgaacattgttgtgtgcacaactatggaaaggtcttaatccgcacagtgactctgagataagactcactgaaggaaatacagcagcaaacccaggagatgtgagttccaatcttcatttgtaactcactccaaatgagatcctagcaatgaagtaatttttttttgtttcccactaaaaacaaataaacaaaaaccttagtttttctatgctacagaattaggatgacaaatgaacttatcttgcagtcactataagaacactgacagtttcagagatagtattaaaaatcaactaaacacttataattattgtgaaagcatttatctatcaaagaaggttagcctgcagccagttggaaagttttttttgttgtttttttggtttgtttgtttgtttgtttgtttgtttgatagagacagggtctctctatgttgccaggctctcctgggctcaagcaatcctcccgcctcagcctcccaaaatgctgggattacaggcatgagccaccgtgtccggctgccaggtggaaagaacaatttaaggagatggttaaaagtggaaaagccaataacatggtaataattg

SEQ ID NO: 203 - DNA, 2363 bp, Homo sapiens
tagacgaaagcacagttctgagcatgagagctcacattctgtttctaccaggtgctgaagaaaagcaagacaggtggttaagactgaagagttaatcctgcgctgtgctgtggagtgggcagcttctctccatcttctctcaccctgacacactgtcttaggattccagtctcagaagccagtcttgaggctgaagtgcagtggtgtgatcctggctcactgcagcctctgcctcccaggttcaagcaattctctcacatcagcctcccaagtagttggaattacaggaacataagctccaggaaagccacagactatggccacctacatcttgaagctccgtgcctgcccttgggagacactaaatggagtcttgctctgtcgtcaggctggagtgcactggcgtgatctgggcttactgcaacctccgcctcccggattcaagcgattctcctgcctcagcctcccgagtggctgggactgcaggcgtgcgccaccatgccggcctaatgttttgtattttagtagagacggggtttcactatgttggccaggatggtctcaatctcccgacctcatgatccacctgcctcggcctcccaaagtgctgggattgcaggtgtgggccgccatgcccagcctcatgagggttattaagcacataattatagaatgtgttttcttcttttaactacgataagcattgttcagtattctgtgggtttttctttctccttgcaatgtcaacagaatacataatgagaaaggtcatgtcagggtctttttgtttctcaaagatatctgatgaaatctgaggaagtcagctttacaaataacataaactctggagctccgtaagctgaacgagttagtcttggaagagttgcctctgcagcattgctactcagaacttctatgaaaaccacaagaagtggtgagaggaagcggcaagatcaatgacagaacacaaataccctcttctgccaaccgcttaaaaggaaattatggggggctgggtcggtggttcggtggctcatgcctgtgatcccaacactttgggaggctaaggcgagaggactgcttgagcccgggagtttgagaccagccagggaaacatacagagatgtcagctctacaaacgataataaaaagaaaattatccaagcatggtggtacacgcctgttgtccccactacttgggaggctgagtgggagaggctgaggttggcagattgcttgagccatgatcacgccactgcactcagtctgggtgacagagcaagacccagtctcaaaacaacaacaacaacaacaacaaaacccagaaaattcttcacaaaggttatacattttctcaataatatacaaatttgagaaatgtgaagtacatttaattgaattatgtaaaatataacacagacttcatatattcaattcacaaataaattttctaggttctttactttttcatgttcatatgttttttatgaagaacatatggtcacctaagaagaataaaataaaaacccatcaaacagaaatattcatatcctccccaaaccgtattatcttaaacacaattacaaacttatttaattacacaagtgagaatcttaagctgagagaagaaaatttctagagaaatttcttttgttcattataggattatttcaatactgaaggatagtcttcgacattagaattgcttccttttaaagtgtacaaatgccagtgtaaaaggaaacatcataacatccatttcagccttaattttctaatggctcaggccgtttttatacagtgtattcttctccagtgtcttaagatagtttggaaacagtacctgttgaacctttcagagagcagtctaccatatatcccttgatcctcaatttctaatttagattcatttgtggttgttacagttataagtaatgtacatttaagaaggatatatctgtagaacagtttctgcacttatatgtgtatataaattatatgtctgctaaattttttttggcctttgtacttgaaaaaaaattaacagatgttaaaatatttggctcacaagcaatgttaaaaacaatctgtagataatgcttccttatttttcttggattaatgtaaaatcaggattaatttgctttgtgtacctgggaaataatctcgtttgtatgcttgtttctaggatgtcttttactcttcataataataaaaaagtcagtgcatgtcagtatatacatatccttcttgattttatctggaaattattaggtttgatctcaattatttatcatttatatccattagctttttaacccataattgtcattattaaaatttttttcatgtttgctactgtg

SEQ ID NO: 204 - DNA, 2047 bp, Homo sapiens
ctccttttgccatggcagctagtggggaaagccctttagcccgctactcttgccttccacggcttccgccaccccaggccagcttccacagcagctgtagctgcttcgttccgcctccgtcttagcacccccaggtgccggcggcccgggccaagccatcgcctacagttcggtgagtgtttccctgccaaaaagctaatgatggaagggctcggagaacacagcacagccggtgaaatgggcccattactcggcgctgtggcagccacagtctctccgcagtctttgatggagtactcctcagacgcagattttattgagagcctgcctctggtggttaagtaccgagtgtacactctcaaaaagcttcaggccaaatgtgccgtgctagaggccaagtacctgagggaatttcattctgtcgagaggaagtttgccaccatctatggacccttattggaaaagagacggcagatcaccaatgcactgtatgagcccacgaaagaggagtgtgagaggtgaagtccaaggttgaggactatgagtataatgaggtggccggtgattctaatgctcagatgtatggtgcagaggagaatccggagtatgaggacttggtggaggatcgtgaggaggatttcgaggatgtcggggaggtgtttggggagtatgaaggaatcgagggacataatgtggacggagaaaaagataatcctacagggatccccgatttctggctcacggctttatagaatgcccaggaggttgccccgctgattaagaaatatgacgaggccaggcgcagtggctcacgcctgtaatcccagcactttgggaggccgaggcaggtggatcacaagttcaggaaatcgagaccatcctggctaacacagtgaaaccccgtctctactaaaaatacaaaaaaaaaaaaaaaaaaaaaaattagccgggggtggtggcacacacctatagtcccagctgcccaggaggctgaggcaggagaatcgcttgaacccaagaggcagaggttgcagtgaactgagatcgcaccactgcactccagcctgggcgacagagcgatattccgaaaaaacgaaacaacaacaacaaaaatatgacgagcccattctgaagctcttgcaagacgtgaaagtcaagttttcaaaatcaaactagccactcacttttacgctggaatttcactctgaacccaacgactacttcacaaatgaggtgctgaccgaaagaaacatacatcctcaagtctaagctcgattagtctgacccccaccccttcaggggatctgcggtagagcgttgctttggcagcatgatagaatggaagaagggaaagaacgtcactgtgcaaacggtcctgaagagagacacagtttttgggggctgatgtgtaccgccactcaggaatttccccaagagtcccttcttcaatgctctccagtggggcctagatgctaatgaggatgaggaagacttcttcatcgctcacaccttgcacacttttgtcatcccaagagctgtgttacactttacaggagaagcccttgaggcagagcaagatacgatgatcagggaatgtaataatccggtttatgacagaatgactcaggagaattgggtgactgcagtttatggtgctaaaggccaaaaccgaaactcccaggcagaagtcaatgattgttgaagcagaatggttggagtatgtgggcctccaggttaacaactggcttttacaataaccaaaacttaatcattcgttacttacagtcttaacgtgtctcttcttggtagtctcagtttaaaactatgtccaaatatatttaacaatgcatttcatctagcactccagtggtgtaaactttgtcaacaattttattaggcagtgaattctcaacgtatgtgaagaccttactattgtgaatccatggcttttgtcaggttgctactagtctgcatctatggaaaattaccagaacttgtaactaagatctacgtttgggtttgtaaaataaagtgagatagcatcctt

SEQ ID NO: 205 - DNA, 2305 bp, Homo sapiens
ctagttctttgaaatgtgatgtcaggtccttaatatgtaagctttctatttttttgatgcaggcctttaggctattaacttcccttttagtactacatttgatgtatctcacaggttttattatattgtgtttctatttccatcttttttcccacaaatttttaattttcatcttaatttttttttttttttttgagataggttttacactgtcacccaggctggagtgtagtggcgcagtgttggctcgctgcggcttctgccttccaggctcaagcgatcgttttatattagcctcccgagtagctgggaccataggtgcacaccaccacacctggctattttttcatatttttttttgtggggacggggttttgccgtgttgcccaggctggtgttaaacttcttacctcaggtggtccacctgtctcagcctcccagagtgctgggattgcgggtgggagccaccacccctggtcaaccatcataattacttcatttacatagtcactgttgaggagtatgttatttaaattctttgtaaatttatagtttctgaaatttctcttgatactgatttgtagttttattctactgtggtctaagtaggtagttcgtataattttgatttggggggatactttgttgatttgccagatttcctatctcaatggtctctctaatgctgtgagtagaatgttgaatttctccactattattgtattactgtctatctcgttctatagatttaataatatttctttgtaaatcagggtgctgtgatgttgggttcatatatatttagaattgttatatcttttggctgaaatgatttctttattattggatgatgatctttatccttttttgttacagctttttaatttaaagtctgttttatttgatgtaagtatagatactcctatttacttttggtttctgtttgtgttaatatattcccccccatttgcctttaatctatatgtgtcttacaagtaaggtgagatttttgtaggcaacatagatttgcgttattttttctcattcatttcataaatctatacttttttttttttttgagacggagtcttgctccatcgccaggctggagtgcagtggcgcgatctcgtcccactgctcactgcaacctctgcctcccctattgaagtgattctcctgtctcagcctcctgagtagctgggactacaggcacacaccaccacgctcagctaatttttgtattttcagaagagacggggtttcatcatattcaccaggctggtcttgatctcttgacctcgtgataccctcacctcaccctcccaaagtgctgggactacaggcgtgagccaccgcacccaaccaaatctatacatttcaatgaaggatttaatttatttatattcaaggtaaatattaatatgtaaggttttgttactatcataatgttaattattttcttgtcttatttttttatctgtctttgtagtttaataaaattctgtcatgttgtgatttgatttatttcactttgttttgttttgtaagacctgttagttttatacttttatatattttaataatggtgaatatcaatctcttgtttttatattagaattttttttaacatctttcataggcccagtctagtggtaattagtttccccagcatttatttgtcagggtaagactttatattcttcatttgtgaaggttattctagcttgatataaaatttttggctggcagttttcttttttttcaacactctaaaagtgccatcccattctcttctggtcagtaaagtttctgctgagaagtctgcttttaatctaatgtggttttctttataaattactagatgcttttcttttgcttattttagaattacttccttcactttgactttagatattctgattatcatgtgccattatgatgtctgttttgcaatatattttgtttatattttgttgtattttgtttgctgagcttcctgtgtatgtatgtctaattctattgctagagttggaaagttttcatcaattgttttcttaaataggttttctaaactttttgatgttttttcttcctcagaaacactgataattttaaagtttagttacttcatgtagttggaaacaaagtcttcattcttttttattcttttctccttatttttgtctgagtgtattattttaaaagacctgtttaaaggtttgaaaattatttttatgtttcttccagtctattattgaatctttgaatgtattttcttttgcctgcaataaatcttcagttccat

SEQ ID NO: 206 - DNA, 2392 bp, Homo sapiens
tattttatttcttttttccttcatattattttgttgccacattataataccaagagaataatactctcaatcattataatttctcataataaactacattaacatttcaactagttcctataatgaactacattaacatttcaactacagtagtccctccttatcctcggaggttagcttccaaaacccccagtggttccttgaaatcatggatagtacatatccctatgtgtactatgtcttttccaatgataaggtttaatagatatagtaagaaaatataaaatataacaatagaactcagaatgctatgcagtttaaaacttacgaattgtttgtttctggaattatgcccttagtatttttcaacccaggttgaccacaggtaactgaaactgtgggagagcaaaactggataagggggaactaccatatttctctatagcataggattctcttaactggacaaaagcagtatttcgagcacagaaaataactactttcttgtcatgttgctctgtttttccacatttctcttcgatttccctatttggttttagccatgctgtgtccttgagtgggcaggttgctcctcatcttgtcttcacagtcctgcgtgctcacaatgatccacctgtgggtgccaggtgcttcctgtgcctcctatgggcccgatggactcatgctttgactctggtacctactgctctttctccagtgctgccagaaccagcttcccactaatccacacagttgttttctaattgctccaggtatgttcatcttatttgtgtagttaaacgacaacttctctaaaaaagggtggtatcttatccagtgttgacctcagagtgagtatctcctaatcacctgctacttgatggattaaagcgggtaagtgctacagctgcccacagaaatgctttacagaatcctaaacagggaggcacccagttgaaaacagaaaaaatacatatgtttttgttagctccagtggcaacagggatcaacagtcacaatgatagaggaaggggcattcaaggaaccattaatgagcaatgtgcctcctctctcaaaatcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaactt

SEQ ID NO: 207 - DNA, 2052 bp, Homo sapiens
gatgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctacggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcacaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgagcccgagggccgcgcgcgcctctgggacgttttccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaaatggaggacttggcgggcagcaggaggcaagggttcctccatctgcccagatgggagaatagggggctggacggcgaccccgagctcttcgagcgcttcctgggcgccgacttccccttcaccgtggccgaggcgcagagcctgctgcgctgcacggtcaacctggaccactccatccgccggcgcatgggtctcatccgagccgtcagcgcgctcaagccgcccagcccgcccaagtcccctacccgcgataccccccacgctgcccaccgggccaacagcgcccccagggtccgaatgagccctgtgaggcccacacccccaggtgaacctgagccagagccgtggacatagcttccaaggagtgcggccacaagccggtgccagcatgagagcaggcacagaaggaccagtgaggaagtcagggtatacatgcaataaatggaggtgttgag

SEQ ID NO: 208 - DNA, 2701 bp, Homo sapiens
aaaagcaacgacgatggctggcagctgagggagagaccagcatccccagaactcccttttggtccttgtccagacttcaaggtctccatggaccactttgagccatatacgtctgccagtcagtggcctctgcacccacgtcagaagcagcagaaatccaaagagcccttggcctctggaggcggcagcaggagtgctctccgaaaagagactgggccagccggtgggagcccagcgcccacccaccgctcatcctacagcaggaccaaccccccgccaacccccagcctccggatcctctctccaggccttggaggaggctgcagaccggtgtctttagacaaagcttccggtgccttcactccccctgctcaccaggttcagcagcggatgaagagcagagagcagaatgaagccagcttctcccagtcctagagaacaggcccaccctccagacagaagatgcacagctgctaagagattcttgactgcctgccttcaagtattttgattccaaataggctcagtctcccctgctggctgagccttcccaatcgtgggctcccgtgggcaggaggctctgggctgcatggccaaggctctctctgttcctcttagttcaactctccttccctggccatctccctttccttccttcccccaggctgaagccctccccactcctcccctggggcagggccactttcccaccctcctcaaccagatggagcctctcactttcccaggagaatccaggctacactccaaagaccgaggcaggatgttcccagacatcgttctgcatttatacccaaagggctcaattcacttcaggtcattgagaccacacagaaaatgaggcttctgctattttaattattttgattattattattattcactaacatttctattagcactttccagtttgcaaaatacttttgtgtgtcatctgcacagcatcttgtgagataatatcatccctcatctttttttttttcttttttgagacggagtctcgctctgttgcccaggctggagtgcagtggcgcggtctcggctcactgcaggctccgcctctcgggttcacgccattctcctgcctcagcctcccgagtggctgggactgcaggcgcctgccaccaccatgcccagctaatttttttttgcatttttagtagagatggggtttcgccatgttggccgggatggtctcgatctcctgacctcgtgatccgcccgcctcggcctcccagagtgctgggattacaggcgtgagccaccgcgcccggcccccatcttataaataggcaggctgaggctcagagtgggagtgacttgcccaaggttacgcttacacagttacactggctccctggactacatactttccactttacccaacaataaccctttccagaaaaatcaggctggaggaagcaggagagacacttaagaatgtatggcccccataggcatcagttgcaattactacttgagttacttgactgttttcattccccaggcagggaaactgaggcacagggataggactcaacctaggaccaagtctcatggagaaagaaggaaagaggagcccatccaaaaaaggggttcctcagttccttagctgcaaattctgcttccagccctagcgctaccatttctttttgtattacttaggcaggttatttgacatctctgagcctcaattttctcacctataaaatgggagaatccctgccccatgtctgtcactgggctgctgtgatgggaggtcagcagatgctggcagaagagaagggacaggacccttcattccctctctgctctgtctaggaggcaggagaaattctttcctcttaaattttaactggatggaacttaatggtgcaaaagtccaggatacaggaaagccaggaggagaacggaagtgattcgctccactggctgggaaagcaagggacacagagtcagccacagacccccaaggtcactgcggggcagagactcaaccaaacacttcaggcagggcccctcctatctcccttttatctttcaaaggaggaaaccaaggttctaagcaaagcagtgacttgccaaggtcacccacaagtagtcagtggtctcctgactcccagccaccagggcccttgactactgggcaagcagggtggggtggggagcactcccagcccaaggacttaatctttcattcagcaagcagtaatgctcacaccaagccaggccctggacactggggaaggctggaggaattgaatacagcctctgcccttgaattcacaatcaatctagtggaggcacgtaccccagcacatcagaggatactagaaggtgaagcaccaccattttctgagcacttcctctgtgcctggcactggacacacattcacttgtttaatcctcaaagcaattctctggcactgaaattattaatccctttcacagctgaagtaactgaggctcagaagggttagcgaccccaaagttcatccagctaataaatggcagggtcggaatatgactgacaggtatgtctggtgccaaactctgagcttcaacccttataaactccctgtttttaggtctgtgccaaccaatatggtagctactagccatggctagttgctatggagcacttgaaatgtggctcgttcaaataaaaatgtgctgtaaatat

SEQ ID NO: 209 - DNA, 2258 bp, Homo sapiens
atcttctcctgcagcaggcccatgcgcgtgttggcgccctcgtcctgagggctcagcgccagcgcctgctggtagtccgcctcggcaaaggccaggttgcccagctggaagaagcaatctagggtccggaggcggggatgctttggaacacgtggctggtcccaaagatgtgctgcaggatccctttgggggctggaatcacccatggctttgggatgtcccgtgaggggccctggtcaaccttcagggcatcctagaaccgaaggacagcaagctggagcaggcccccgagacggcccccacccactgacacactccccagcattctgcagggagggaggagaggcggaaatgaggcctggaaggaggcactcccactcggggttccggtggcgctcccagccccattccccttagggacgctccaacctgtccctctgcagtcctgcccttctccctctcctgtggtcaaggtcagggatcagggtcctcatgcttacaacaccgtctgttctcccccagggccttcccagctcccacttccggctactgacaccccaagctttgatgtctccagctcaggcctggtcccaagtctcaggccttgggggtcctacagtcccttgggtaaccttcaggaccctcactccagcaggccacactgagcacctcacctgacttctgccccaggttctcccattttggtgaggtcaccttccccatcagctacccaagccagagacctctgtccaagcagccgccgagccttacaaggatctttcacatgcctggttcttggcatggcggccagggccttccctgagtcggactgctgcccctgcctctcccggccttcaccctttcctgcgaacccagcctcggtctctctgcctggccctctgcctttgcgttagtcttctcccaagcccgcacctcgtccgaatctgtcatgaggccccttccaggaggaccccgaggcctctgccaactacctcgcggccctggccctgacgttgctaggcaccatcaccaggacgcccacaggccccacccctctggccacgcccccgggaaccaagctttttgagccggagggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtacatgatgagctggacaagcccctggggagactggctctgaggctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactgg

SEQ ID NO: 210 - DNA, 2965 bp, Homo sapiens
gcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctccggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccgcagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtagtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 211 - DNA, 1992 bp, Homo sapiens
atgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccctgggaaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaagttgtaagaggatccttgtcaccccagccaggtatccccaaggcagagcacctctcgtttggccctctgaacaaggtgcacgcgagctgtgggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccact

SEQ ID NO: 212 - DNA, 1994 bp, Homo sapiens
gcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaagcggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcagcctccacctcccgggttcaagagattctcctgcctcagcctcctgagcagctgggatgacaggcacacaccaccacgcctggctaatttctgtatttttggtagagacggggtttcaccatggtctggtgacctcctggtctcgaactcctgacctcaagtgatcctcccgcctcagcctcccaaagttctgggattgcaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaat

SEQ ID NO: 213 - DNA, 2173 bp, Homo sapiens
cttctcccccgccagctcgccagctcgggagcttcttgagagcagggtccatggcaggctttgctcaccattgcgtggctccaggctcatgtttccctcagacttttattcattcaagcagcatgtattggatacctactatacaacaagcattgttctaggaaccagggatacggtggcaaaaatgacaagccatagaccctgccctcatgaaacttcatgtagaggagacatacagcagatcgaatcctagactcactgtctgatccggaaggcactttaatcatgcctaagagcctggagatttataaaggaagctgtaactgggaagaatccggcctgctgggaagctgcttctcccagggtcttgctctattaccccgagtggagtggagtggtgccatcttggctcattgcatcgttgacctcccgagctcaagtgatcctcccacctcagcctcccacttttcgggactacaggcacacaccaccacagccagatggagtctcactctgttgcccaggcttgagtgcagtggcacaatctcggctcactacaacctccgcctcctgggttcaagcaattcccctgtctcagcctcccaagtagctgagactacagaggcatgccaccacaccaggctaatttttgtattttcagtagagacggggtttcaccacgttggtcaggctggtctcaaactcctgacctcaggtgatccacctgcctcagcctctcaaagtgctgggattacaggcgtaagccacagtgcccggcccaaaagttgctttctccaacttttgggctgaactctgtctctttgtggcttccatccattggtcacagtgctgcctctgggggccacctaagctctgtcttctccctctgccctccaacagcttcttagaggtctgaagcatcaccatagccataacccctgagtcttctccaagcaaaacaactccacttccttcaactgttcttcatgagaccagggcccccgctttctccacagcatgcttttgcctccctggtcatgctccagtgtgactctggtacccttaatatgtggcacacagagctgacaccatattccagggcagtctgtcacctccttgttcttgaaactttacttctatactgcctacagatgcagctgaaggttccatggatgtatttggtcagaccatgcatatgacagtcacctcctcacctctgctccttgccctctcacctggttcccccttgccagcctacatttgaggactggatccaagagcaagacctaacatttctccctgtcgtatttactttgtaagcttcagcccctccttctagtctgtcaggaatgggaatgtttttgaaaacagactctgaaagccaatgagatgtgctcctcctgcccacagttggacccaggctccatatttgatcagtgaacagccacgtccgcacatgtgccacaaggcatttgtctgcaaattcatccggagaccttgacagatgcctggaggtcagaaatcagcctcctctatgctgccatgtggccccaggagcctgaaggaaacaccaagtacatctagaagttgatggttgaccgatgggagagggggcaagatgccagtcactcagtcagccaacctttcctgaagattgttggaggctccaagtgacataggggataatgcagagaacattcagagacatcatctactgcctgtgcgctctggaagtttctagtctcacaaaaaggaagaccagggaggcccttaagaaaatatagcaggctgaataatatcccccaaagatatcaggtcctaatccctggaacctgtaaaagttacctgatttggaaaaatgatcttggcagatgtgatcaagttaagggtttctaaatacaatcacataagagggaggcagaggagacttgaaacagatggaaaaagaaaagaaaagaccacgtgaccatagaggcagagattggagtgaagtggctacaagccaaggaatgctggcagccacagaagctggaaaagacaaggaccagattctcccttagagcctctggaaggagcatggccccatcaacaccttgattttggcccagtgatactggctttagacgtctagcctccagatccgtgagagaatacatttttgttttcttcagcc

SEQ ID NO: 214 - DNA, 2131 bp, Homo sapiens
tccattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactcacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggagactgaaaaatagcagttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatat

SEQ ID NO: 215 - DNA, 2002 bp, Homo sapiens
tttttttaattactcctttataccagtaagcaaacttggagaatctattccctaaaattttacagggatgtggagtagacacttttgtctaccattaaggcttagctggagtcagaaagaaagatataattaggggtcacaaaaggtttttacctgatgctcttttttttgttattgttgttgttttgtttttgtttttgtttttttgaccttgagggattaaggaagaagaaggggaacagagaagcagatgacaagaggctcacatgggtgtcccaatttcccttctctggactttgacttggagagggtgcaagtacattagagagaacactgagaacaagagaggagacattgactttgcttcccatttaacactgtgcaagaggccacctcttgaattgccccctgccctaaactgtagtatagccatggcaactggacagcttggtgtggttgggcagagggacgtatcttcgccatcttgggctgccataacaaaattccatagattgagtgatttaaacaacagaagttaattttctcaaagttctgggggccaggaagtccaagatcaaggtgctggctgattcaatttctgatgagagctctcttcctggcttgcagatggctgccttgctgtgtcctcatatggtggagagcgagggaatggcctccctggtgtctcttcttataagggcactaattctatcagattatggctccacccttatgacctcatttaactttaattacccccttaaaggccctatctgtaaatatagttacattgagggttaggctttgtgttagtctgttctcacgctgctaataaagacatacctgagactggatagtttataaaagaaagaggtttaattgactcacagttccatatggctggggaggcctcacagtcatggtgaacggggaatgaggagcagtcacgtcttactaacggtggcaggcaagacagcttgttcaggaaaattcccgtttataaaaccatcagatctcctgagactacaatgagaacagtatggaggaaaccacccccttgattcagttatctccatctggccctgctcttgacacatggggattattataatccagggtgagatttgggtggggacacagccaaaccacatcaggcttcaatatgtgacttttgggggtacaaagttcagtccatagcaattcagtcctttggaatttagcatcctggagctgccctgggatcctgaatggtctacgtcaacccagaggtggctgaggatgtggctgaagagtttcctagcaggggccacagtaccagagtgaggtaccagacctgcatcctgcttaaaaatccagcatgcaccctggagaattgctggcacttggcaaatatttattgaaatgagccgttgggctgtatcttctttttgcatgtgtaataggagtgtcccttgttctccagccttcaggagtcaccctttccttgaacgtcctctgaatatcagccccagatctgtaggaagtccacttgagtcttcagtaaatgctgatatgttctttttctttgagacagcgtctcgctgctgactcccaggctggaatactctggcgtgatctttgctcactgcaacctccaccgcctgggttcaagcgattctcctgcctcagcctcctgagtaactgggactacagcatcccccttgggaggatgaggaagaaggtcacattctcaggatggtggagaaaaaagctagaaggagactgggtacctgatgtccgtggtgctgccctgttagctctggactgcctttcttcaaattccttattaagaaaaacaacctctgtcttgactgatatgcttttatttgtttttttgtttgtttgttttttggttccctgcagttgaatttaattcccaactgatataattatgtttagtgcaaaggctcaactgggtatgattgtcatgagatcacttcagccaataaacagaaattatgat

SEQ ID NO: 216 - DNA, 3127 bp, Homo sapiens
agtgagaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacagtagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtcttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcaaaaaaaaaaaaaaaaaaaaaaaaaag

SEQ ID NO: 217 - DNA, 2256 bp, Homo sapiens
agggttgtcatagaaaccactccctggggcttggcaaagcaggagccctccgtggcagggcttcggtgtcggggctccgaggctccggcctgacttctccacggggtccacaggagcgtctccggatgccaggacctgaaatgggccgaccaggatgaggaaaccacaggcagaggccggggaagcagcgcggcatcccatcctcaggcctgcccggacggtgttcgggatcaagaggaccacactccagcccaggacaaaagccccacggtagcacattgtccggcaggagaggagcagacccacgtccaagaagatggttgtacctttccgcgcctcttctctgcgaaatgaagccacatcatgacacaatcttgaagaggaagccgggaatgggagacggcaacaatccctgtccctggaacgctggcctctatggacaagccacccgcttcgcacccctccccttatgcccgtggcggtggcacggcgccgtatcctgcctgggctctggcctctgctctgtcctccctcttccactgtctcccctgtttctcagcggcctagatgcctcttggtctggctgaatatcttctatgaagatcacttccccgtccatcagggagacaattcctggagattcgtgtcatgactgtttctctctccaaacctgtttctgctggattgcgcaggtctgatgaccctggagctcttggcttccatacgtgtctcagacagaatcatctcccctgccccacaaacatgaaagaaaagacaagagaagcaccccagaagaggaggggagaagtgccccagaaaaaatcatccagtctctgaagctttgcccaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcacgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaaaaatatgttggaataattttaactgccagacctttcctcttctggtgcctgagggaaacgccctgctgcttttagctgtcttgtaacccacacgccttttcacttctgaagttgcaagaataacggctgtggtttttcacacaaaagggttgcagactgggttaggtccctgttccgccaacctggccgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgattcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaacttt

SEQ ID NO: 218 - DNA, 2173 bp, Homo sapiens
tttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacaggtttgttggcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaagaaaggaatgtgaatgagtcacttaacagggaatctaaagagctgtgttagctgtgtacatacacagattatctgagaaaaggtcaagggttccacttgggccacagtttttttgttaatcaaacaccactctcttaagaggctgcaccacaaaaggcaacaaagggcccctctaaggcttgagattaaaactagtctttatcattactgctgtgacactcttgcttagtatattaagagactcatacatttttgatatcacaactttttgatggcttttcaatattctaaatttgggttcctggtgaaaccaaatggggtacactttcatatccaaattaataaaacctataaggcatctgggtggcctctatgaaataaattaattacccatagtgtagtttctaggaggcatgtgtacacacactcttcattgtggcacaaatttaaatcgcctcatgaccatgtctgtgagccagggtcaagctggtttggccttcttgatgcattttccaaggcccactggtggagcagcatgagtttttatacagttactaacgattgtggaaaaaaagagctttagccatttcttactaaaaacaaaacaagtttataattaattctctgagcgagcatttttagggataagcctaggaggtattcatcggtgatggtaacaaataacatggtatttgaaagaataaattactaggatcttttaaatagtgataatacaaaagtaatcttaattagtatcacatactaaaagacaactataacttctgaaaaatatttattcttgtttgatgaaagcaacgtttctcagcaatgcattttaaaaaatattttagctgtaaattaaaaatggccataatgtacccttggcagacttcagcatataccaaattttaaatttaaatcagcttgaattcagtggggtatacaaatcattttagttgttttagggctttttattgaatagaaaaaatataaacaatgttgtagagtaatgagaaatcctccacactgaaaaaaaactagtagttttaatttttttggaatcatattttctgaggtgtaactggctttcattagatgatcatacttttcctgacatttttacaatgtattctttctttaaatataaaaactgacaagataaatatagtgtttcaacttctt

SEQ ID NO: 219 - DNA, 1996 bp, Homo sapiens
agcctgtgggtatcatgaagggagcaagcaacatcagaggttagcctgctgcagtgatcccgtcaggcctgatggtaacaacacagcaggagccaagcagaagcaagtctccagcttacagccaattaaacaccttctcaatgtgaagacgacacgaatgaagacccttatgataattgacttccactcaataaatagtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggagtactgtcttaactccagtaagaacaaaatcaccaaggccccaactctgataagatcattccaacctcatgaggaccgaataagttccttagagatgtgtgagccaggtggtcagttactgattatctcctcctctgcagactgcagtatttgtgtgactggtgtctgcaatgctcctgtttggatctttggtcaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacccgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 220 - DNA, 2377 bp, Homo sapiens
agttttacctttgcaggaacagtggatgcttatcagtgtctttgattcagaacttcgtggattctgtagttgttttagagaaatggggtcttgctatgtggcccaggctggtctcaacctcatgcgttcaagtgatcctcctgcctcggcctcccaaatagctcagattgtaggtgtgagccacttggcacagcggtagaactttatgtttaaatgttatgtaaaaagtctaaatctgaccagccgtaggaacttggctgaagtaaattgtgatatgttcacacagcacaaaacggtgtagctacagaaaaagccacagaaatgtatctgtggaaagatgtttggttgttttgggttttttgtttgtctgtttgttttttgagacagggtctcactctgctgcccagtggtgcgacgataactcactgcagcctgaacttcatgtgttccagcgaccctcccgcctcagcctcccgagtagctggactataggcgctcgccaccaagccccgttaattttttttttttagtagagtcaggatccaggctggtcttgtatttttattttagtagagactatgtcgcccaggctggtcttgaactcctgggctcaagtgtcctcctgccttggcctccctaagtgctgggattacaagcgtgcgccaccacacctggcacctgcttcacgtcaggcgctgtgcaaggtgccaggagcacagccatgtacgatggacgtggctgctgattctgcagtctcagatcccaggagagactcacacatcagtgcacagcgtcatcccatctttgagtctctgctgggcctgccttgtctgaggattaacggccaccttctttgtctgtgtttttagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcaccat

SEQ ID NO: 221 - DNA, 2401 bp, Homo sapiens
gagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaggtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaac

SEQ ID NO: 222 - DNA, 2585 bp, Homo sapiens
accttccgaggactcaagtccttgactcacctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacagattttgtgttgtaccagaccctggccttcccagcagtgtcggctgagcccttcctctactccagtgacctctatttggctctggcccagccaggagtcagtgcctgcaccatcctgaagtgggactatgttgagcggcagcttcgagactatgatagaatcccagccccctctgcagtgcactgcaagccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccaccagcctctaccgctggcaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcagcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccagctactcctggcccccagcttcaagggacagacgctggtgtatagacacattgtggtggatctcagtgcctagggggtgccgaggcctctggtctcctcagggtggccactggaggatgggtgggggcctctgtgagcaccacgtatgcctgtgtgaagacaagcgaccaacctgcattcatgcccttgtatccgcacacgcccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgccccctgtctcatgcacgagtggtgcggggtgctgggagcgaggggggccgcatcctcctgtccttgtgcttctccttctgcccctctggtctttcctgttggtgctccaggcattgtttacctgctcttgctccccgctgtagcccacagccatatctgtcatgcttccccggggccactcacccctgccccaccccgtctgcatgctcacatggacgcggacggacacactcattacacactcacacgccccgactgcacccggtgtccatctataaacatgtcagggcacgtgtgcatacaagcagattcagcactgcctaccaggctctcctgttaccttgcctctctgcttggagggggccccctctgctcacccccagcgtgccccccccggaactgataaggatgagaatggtggtgccagcttctgagggcctgcttggcctcctgggggcaaagcccctctgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtgggggctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccat

SEQ ID NO: 223 - DNA, 2019 bp, Homo sapiens
gatccggccctccgcggctcctgcgcgaccccacgcaaaagcgccccgtgcgaagagcgcggccagccagtccgcaaagggcctcgggcagtgcgggcagcacgaacggcgcgatcggggagcaggcgcggctacgctccgcctcagtgatgtcgccgggaggatctccgcgcggctacctcctcttccgccgccttcctcccacgccttcacctccctcccccgccgcgctctgcggcgaaaaggagcgggctcccaggccacctcccctctctccacccaggggccgcgcgtcagtggacctgcagcccaggcaacggggctgcggacggcgcgcgtgccctgcctcgcctcacgccggtagctgatgctcccgcggcagctgccaccccagcgccccagccacggcttcagaggctctcgcacgctggctttttttttttcccccccctttggtgaactcgcagtacttgggctgagcccgaaatctcgcgagatgctgcaggcgtcagtgcggcttcccactaggcgcgtggtacccgaggccgggccggagccgcaggccagccgcgattccttcgggcgatgctgggggctttccggtcggggccgcagccgcttccggagccgcgggcgaggtgcgttccccagcctggtttgctctgggctctgacccgccgccgcgaatctccgctcgtaactccgggcctgaacctggaggagggaggatttcctctgtgcagctttcgagcggtagactcaccctgccaggcagacctagattggcataaccagagatcagttccagttgtgatgcagtgggtgtctacacacttctgatgacacctttattttaaaagctgatgttccaaggtgcaagcggtcttctctgtcttctttatggccagtaaaattctccagaagagatttatggcagcctcactcccagtagtttctgcatttagtgagataaggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtccgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacaggtgagccacacccctgtcgcacgccctgcaaggggaatcagggaactcttccgtttcattgctttgaccacatcctataaatcttgttctccttgtctttcagctccaatttgtttatacattcagtttttacttttgactttactcatgatttattatagaaagatgtttaacaattttcaagcaaatggaataatttttgctcctctttcgttgttaatttattattcattggagttagaaaattgttgctaaaataaattctgcattttgaaattt

SEQ ID NO: 224 - DNA, 2746 bp, Homo sapiens
ttatgcaaatttctacagccggtttgaatttctcctcagaaaatgggattttcttttctattacattgtaaggctgcaaatcttccaaacttttatactccccttataaaactgaatgcctttaacagcacccaagtcacctcttgaatgctttgctgcttagaaatttcttctgccagataccctaaatcatctctctctcaagttcaaagttccacaaatctctagggcagaggcaaaatgacaccagtctctttgctaaaatataacaagtcacatttgctccagttcccaacaagttcctcatctccatctgagaccacctcagcctggatttcattgtccatattattatcagcattttggtcaaagccattcaacaagtctctagggagttccaaactttcccacattttcctgtcttcttctgagccctccaaactgttccagcctctgcctgttaccagttccaaagttgcttccacatttttgggtatcttttcagtagtactgcacttctggtaccaatttattgtattagtccattttcatgctgctgataaagacatacccaagcctgggcaatttacaaaagaaagaggtttaatggacttacagttccacatggctggggaggcctcacaatcatggtggaagacaaggaggagcaagtcacatctaacatggatggcagcaggcaaaaagagagcttgtgcagggaaactcccatttttaaaacaatcagatctcataaaattcattcaccatcataagaacggcgcaggaaagacccacccccataattcaatcacctcccacccagttcctctcatgacatgagggaattgtgggagttacaattcaagatgagttttgggtggggacacagccaaaccatatcactgggactgcctccttcagaaacctgtgtaattttaaatttgtaacattcagcactgatcacatgaaacagaatggggtgggtataacaatcatcatttttgtctataaagaggaatgatgaatagagaaaacacaggcccaggcggattctgagtacagtcctgctgtcctactaactaattagcttgcaactttgggcaagttcctttacctctctggatatttttccttaattgaaaaataggaataataatcattttctcttcctcatagggtcatgatgagtactgaggtgatatatgagtatgacctttttaaaaattataaatttctataaaatattattactgacaagtatcagtggatggctactttgtacagaaatgtgatcctggaggcagatttacaaaacaagggtaaagataagttccagcccatgaggaatttatcgtctatttggttatatgacaaaaatacataatacaattagtgatcaaaacaataccaacttatgcatttattgaataatccatcaatctgtatcatcatccatccatccattccattaaacacagatatgatgaacactgaattgtgggttaaagttagaaaacagaagagtaattaatatggagggtagggcatgagggagccaatggatctcatctgtctccttttgaaattctaaactaatttagaaatacactggaatcagaaagggatccagatatcccttgcactaagggtaaaaccagacggcagaatgccacttgaacccaagaccagatggtttcctattccatttctcacgaattaggttccccatctagacataagctaagcggctctggggtatttaccaggtggaatgccaagcagaccatgcaggccagtgaacaacctctccttggagacagctaagacaggacagctaggggccactgcttagctttgcaggtaacctggactaaggaacttgggctccagctgactctccagtcagacatgtccttccttctctcttgggaagcagccagtaggactggaagggtgggtagagaaggacagatggtttcctttcaatacttttgagaagcaaaatcttcctatcatacaagcagaaataggaaagtcaagaaagaagagttctactgacaggggcttgtcataaagcatcacagagcaaaggaagttagagaaggaagaagtccaaaggggctgacatcttccaagggcatttattggagggctatgttttgaacacaacaaaacatgaagaatgtcttagactgcacaagaaagaagcaaaggggattaagttaaatggaggagatattatatctatctgttattccataacaggtcacctactaagtttattgttgaattgtatacctcagtcttttttaaaaatgtaattattgtaaccttccaattattcaaaacacagtgcttttctttcacaattaacatttttatcattgtatttatttactttaaccttttccttcatttattcagtctgtctcttgccaaaaatagcttttccattattccatgaaataggcttgcctttaagaaaaaaaaaattaaatgcctacagcctctattttcagtcttacttccaaacagactttccacctaggagtttctggcatgatgcaagagcaaggcaataggtcggcaggcgaagattgttttgctcatgtactgttaatccattttctttctcctctctggctatgctgaaagtgacttagggaccagaactggattacagtcttctacttagcagtgtgcctggcacatagaaatacctcaataaaagcgcaaattgaatgtc

SEQ ID NO: 225 - DNA, 3527 bp, Homo sapiens
ttggatgaggaatcaaggcacttaaaaggctaaccacgggcaagtagcatctgccctcagtgttggcagctgatgactccgtggggcatgtaaccatgagcatccgttgtgcacctgttatgcgtgaggctcgaaggctaattctggacaagtattagctcttttaatcctcagaactgtatgacacagatactgttattttacccaggaaactgaggcttaagagacttcttcaaaccttttcaagttgccccagagtccagtcccctacctctgggtccctttcagcagatggccttgtctcctactcgatgggggaaacagaagcctttggagagaaataccttcacgtccctgcacgatctagctgcacgcacactcattccatcctgccatcttcctggtactgaagagccagcccctctacctgagcttggctcttctgttctttctggatcctggcatttccaatcatcctttcttgctctcttaatgatttttttcaacccccacctgcctcgacggatccttcctgttggcttttagatacccacattaagtgccgcaagcaactagctaccaccagaccagaaccaggggcctgctgacctagctggcttgctacttttttttttttttttttttttgagacagagtcttgctctgtcgccagtctggagtgcagtggcgtcatctcagctcactgcaacctctgactcccgggttcaagcgattcccctgcctcagcctcccaagtaggtgggactacaggcgtgcaccaaaacacccggctaattttttttattttcatagagacggggtttcaccatgttggccacgatggtctcgatctcctgaccttgtgatccacccgcctcgacctcccaaagtgctgggattataggtgtgagccaccgcacccggccaacttgctacatttcaaaaggcaagtaggctgagaagtacccttgaggtgctgtccctgctgctttttttttttttttcttttttttctttttgagacagtctcgctctgttgcccaggctggagtgcagtggtgcaatctcagctcactgcaagctccgcctcccaggttcacgccattcttctgcctcagcctcctaagtagctgggactacaggcgcctgccaccatgcctggctaattttttgtatttttagtagggacggggtttcaccgtgttagccactgtccccttttctttctgacccagcccgatgtctgtcccagtgtcttactgtctgcaggcccctccaccaacctgagacctgaattcctgctaggctaggaaaggcctgctgccaatgtgtggaagtttagtagccagggtaggaaaaggcctgccactgaagaacctggagagttcgaatttctctgtgagcaactttaactcctggagccaggtttatcatggtgctggaggctccttcctgagcacccaacagtctcctggaagaaagagatcagataacaagacgaaatcctgctcggcagtacctgagatggccaagcaattcttcaggcctggggcccaagtcactcgcagcagctctgggtcagggctaggtacggatactgggcactggactgagctcacaggatggcagagatcccgggggtcaagaagacaaagacgcccatctgagccaaggctggcaatgctgggcccagggccctggccccagctcccaacttcagcacaccatctctctccaccagacccagggccagggctgcgattctccaacggtgcccacttctgccgggtgtcaacaagccccagccggcccgaagcacagcagaaggcaaaggtgtctgcatctaggacctgcaggctactcagctcctcactgtcactgacatctggaagaccgacagcaaaggagacaagcggctggaggcagatgggtctggcaatttggcagggctggctggtcacaggtcccttcccaccagtcccaggcagaataaatcacatctcccttcccactcatctcaccattgtctgctcagctggttgggtgctggtccctgggactgcctaatcctgccccagcataggagcccttagaggccagggcttacctcttattcactgtgtatccccaacacctggcacagagagttgaactcagtttttatagtggctgagttgggctggggggtgatgccggctggagcagcaagcaagggacaaagtaccacggtacctgaggtgtacgtggtcttccgggactccagatcaacgacctgcagacttcggagcctcgccccatggaggactccgggtgccaatgtggagaagacggccaccctaggccagagactctcctctttctcatgcacagcaatggtgctgacagctttaatgacatctaggggaaaacgaagaggccaaaatccagaactttaatgaaggtttgaaacatgacaggctgccagctgtcttcccctgcacatttagaagatcaaggaagaaaaggagctgccggctggcaagagatgatgttgagacataactactctggcttatgtttacatttttgaaaccatcagaaacatttcaatttctttattatttgtcttataaactgttttttgcaaatggaagacaatgccatctcaaaacccaaaaagcaattctggctttttatacttttgtggagaacaggtagaagacaagaaaaggaatgaacatgctgctgatgtcacttaccccttcagcgacaagaaacaggtacagaattcatgaactgatattatttcttcaaaaacatgttccatgacctcgagtgacttgctaaagcctagcaagtacaggtcacattacagatgtcattgtcttgtaaggtggacaagaaagtccacatcttttttacactgaatggaacatccttggctttgagtcaagttttgttttggttcttttgtttttttgagacagagtctcactctgttgcccaggctggagtccagtggcacaatctcagctcactgcagcctccgcctctcaggttcaagaaattcttctgcctcagcctcctgagtagctggaattacagatgtgcaccctcatgcccagctaatttttttgtatttttagtagagacggggtttcgccatgttgctcgggctgggctcaaactcctggtcaggtgacccacctaccttggcctcccaaagtgctgggattacaggcatgagccactgcgcccagccaagttttagtttttatttggttgtctccacctgcttggttagcaggtaggttctcctctctgtattctacatctgaggcttctcttaatatatgcttaatgctgccaaagaggtgagctcacctgagcagcctaagctctgctgttgccactgcccctgcctagggagagtagttctctggatgaactcaattccaggagcaggttacaggaagctccatttggggcttggatgccatgctatggttgctaattcaccttgtctgcattaaagtagattaattccc

SEQ ID NO: 226 - DNA, 2190 bp, Homo sapiens
tgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagcctcggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 227 - DNA, 2644 bp, Homo sapiens
agtaatactaagggctgcatctcaggctgaccacagggcaggtgccaagttaagtgttttcatgcactccctctctcaccacctgggaggcaggtatgattaaccccctgcagaaaaactcacagtggggaagcggtgccggaacccaaagtccaggctccaactccctggacgtgacatgctcgccagccggggtacaccctgcacaatgctgggagcatctccttgatgcctccaccatcaccgcctggagcgctgatccactcagcacattctggctaagcatctgctgtgtgccaggccccgtgctgggcagtgatgggaatgaaagatgagttagatctcatctctgcccccggggagcctcccatctggtgggagacacagacacgtggatctttgctggaaagggtaacaaggccatggaaacccaggcaggagcgttctagaaatccatccactttcaagtaggacttccatgcccgtaacatccacccaccgagctaatcacccccactcctgccccgctgccctgggacacctatgagatggcatcacctaaatcatcacaaacatctccaaaggccatgctgccagtgtagacacactcattccatgggtgttagtgataccaaatctcccccagctcttagctcgggaggccctgcttgatcaatgtgtgtgtcctctgacgcagtttcctcatttcatcagacctagtgttctcacactgaccacccatccattcaccagacacgacagtgagcaaggcaggtccctgctcactgtgctagctttctagctggggcaggaagacagtgaagaaggaaggtggcgaaggcagtgagtgctctgccgggaactcagtgccaggaactcagttcgagggacacgtgagtgagacccttgtggacctggggtggtctgggaaggccgccttgagcagatgattgaagcccagatttgaatgacacacaggagccagtaatgggcgttaaagataggaaaagagcattccaggcagaaggaacggctagtgcaaagatcctgcggcagccacaggcttggtggtttcaaggaagcacaagaaagccaggtggcacaagaaagccaggtggctggggacccagagggaaggcagaaggagatgagggtgatagtgcccagctctgggctctgctgtgagtcaagctgtgcaaacacaatgtcctgcctttggaaaagcagaacaaacttgctagggcataaagcatcctccattctgcctggctgtccatcctctcaacagccccatgaagaaggggctctccccattttatggacaagaagacagactcagctgggtcaagtggcttgcccaggatcacacaggtcagctgtggaagacccaggcccctggcttcagtctttgggtccagctgtctcctccaggcagtgctgccagtgtccaggcatatggcttggcaaagtgggagaacctctgcttggggtctcgattggagaaaggaatggcttcctctcccctgatgtgagccgtcccagggccatgttgccgtaagggggtgcacagcctgtccactagcccagctgcggaagccacagctgtgtcccacgtgcagtgcctcagaaggcagaggaagccttgaggtgggggcccaagacccagattctgacatcagctctgccactgagaacagcgtgacctcaggcaaggtctgttacctcagtttccccatcggtaagaggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtacagacagcctgcggcaaaggcaggtgcagagtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatac

SEQ ID NO: 228 - DNA, 2400 bp, Homo sapiens
acccgtagggagaggcgggttgcgggcggcggcggcggcggcggcggcggtggtggttgtggcgaggctgtgcggcagggcgcacgggacctgtcctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttatagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtagaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttcccc

SEQ ID NO: 229 - DNA, 2355 bp, Homo sapiens
gtcgcgataaatgggcgccggcggagcggagggagatccgagcggcggcggcaagctggctgcgagcggctgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagggtcctgattgtcacgctccttactctggaattatcttatgcgcctcttccttgccaactgtccggcgtcccctacaacacgggtgaccctgtgggcaggtgggctcggccctgcatctggccttgcccctggcacacgaccatcaacgcactgaaggggaggatctcggaactgcagtggagcgtgatggaccaggagatgcgggtgaagcgcctggagtcggagaagcaggagctgcaggagcagctggacctgcaacacaaaaaatgccaggaagccaatcagaaaatccaggaactccaggccagccaagaagcaagagcagaccatgagcagcagattaaggatctggagcagaagctgtccctgcaagagcaggatgcagcgattgtgaagaacatgaagtctgagctggtacggctccctaggctggaacgggagctgaagcagctgcgggaggagagcgcgcacctgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagac

SEQ ID NO: 230 - DNA, 2218 bp, Homo sapiens
gtaaaagaacaaaagagagagcttgacacaccaatcttgaggtgttgtgccattctctgggaacatacagatgaaatgacctgaaccctgcccaccatttaaccaaaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcttaaaagagcttccaaactcatttttgaataatactaggctacaaagaattacactgtgaattcattaagggtaacaccaaaccactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattgggtgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttatggtactgatgccattcttaatcaagttctgataagtggatggtctctgcctatctccacctttctgaatcctatgtgtatcactgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccat

SEQ ID NO: 231 - DNA, 2125 bp, Homo sapiens
ctcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggtgggcggtcctggggtctccccacgtgtgtaggggcgtcgtccggactcgtggggcacccgggctctggggcacctccttcaatcccagatccctggcgctgccagccgatcgctggtttctaggaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactcagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctg

SEQ ID NO: 232 - DNA, 2692 bp, Homo sapiens
catagccgggcgtgctggtgcatgcctgtaatcccatctactcagggggatgaggcaggagaatcgctcaaacccagggggcagaggttgcagtgagccgagattgcaccactgcactccagcctgggtgacagagcgagactccatctaaaaaaaaataaataaacatgggagaaacctggaagaatatttgctcaactgtgaggcatggttggtggctaagggatcacagaatggcaggcctgcctattcctcctggtttgtaactttcatttaatgagaatgtattattctgaactcaaatacgacatcagtttttaaaaggaaaagtcagtccacagtggagaggggctgttctggtttgaaggggaccaagaggctggacatggaaatccatgggcgatccttcaggggaccctgggccgagctagaaatcagaggccaggacggcactggaatgcagccacgcgggccctggtgggacttccacgcctgcatggtcggctttcatgggtgcttgcgtaccaaaggtgatctggatctcagattccttgttcactaggggaggccagggcccaaggggaaggagcagcctccttgaagcccctcaaccccttgtctgggtccaggcatgaggccacaagcccagccatcccatcacctgctggtcactgcccagagtttcaaaggactggatgtgccaagtcctcacacccagccccgcgtcctggggggatgtgggagccctgtggatctcaaggtgacactgtgtctttggatgcagagatcgttaaggaggctgaggtgccgcaggctgcgctgggcgtcccagcccaggggacaggggacaatggccacacgcctgtggaggaggaggtcgggggcatcccagtgccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacgggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcg

SEQ ID NO: 233 - DNA, 2148 bp, Homo sapiens
agctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaagacacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacccccactaaatggaggacagtcacggagatcctttctaagaaatgaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaatacagcctacgccctcagacaaagatgcctgtgcagtcagatcctctcccttacgctgctccctgcggggtatgtccagtccgtcaagattctccctaaagacacagcctgtaagaaagcagaagtctttgcctctgcctgccacatatcttccttgaggcaatgaagtacagagctggctatttgcttgatggacaaaggggaagagggggagaaataataaaataattgtagtcatagtaatgacaatattgaacatatattgagaatttgctatgtgccattgttctgaacccatatatgttaatatattgatgttaatcctcaaaacaatcttatgatatgaattgaagagttgttctaattttatatgtgaggagatggaggctacgttttcaaggaggctggagaatctgctccaagtcacatgtatcaagaggcagaggtggtatttgaaccaggctaagcaggtcctgaggcttcagtcttaaccaccacctacttttttagaaacatagattaatatgccggaatattctctagctacaattgttgggcttttataacctaaaatcaactcatactaaatgaatcaaacaaacgacaaccaaaaaaataaaaaaaaaaagaccaggagaatggaccaagaaatacagatgatataaacacaatacatttaaagatattattttttgtactttttaatgtagcttaattttttaattgatacacaatcatatatttatggagtacagaatgatgtttcaatacatatagtgtatggtgatcagatcagggtgattagcatatccatcatctcaaacatttatcatttctttatgttgggaacattcaatatcctccatcctccttttagctatttgaaactatatatttattgttaagtatagtcatcctacagtggcatagaacactagaacttatttattcaatctagctataattttgtaaaggtactgtttaattctagcaggagaataaagtgaatgggagagaggcgaacacctgtaaggtccatagtattccagattatgaaatgacacagatatctcaggagaagatgagagcttttcacataatcattccaagaagtttcatttaacaacagatatttattgagatgctatcatgttctaggctattgtactttgtcctggaaacacaaagatgaatgaataatgtacccttacggtaaaatacgtgtacatataatcatgcataatagagtataaatacatacaatg

SEQ ID NO: 234 - DNA, 2118 bp, Homo sapiens
agatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcggacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactcaaaaaaaaaaaaaaaaaaagatcttggggaggcagacagcctcccagatgggcctctcctaaagtagctacaaactgctgatccaggtgacccaggatggcgtgggtgaagaagctcacgacttttcccagcctcctccagggctccatttaaacagcaagcctggtgcagggtgggagagtctcaggtgtggaggcagcttacaggattgagggggcagtgaagaaagaggtttctgatctacatgagtaccttgctctgagcctcccagctcagaaccctccagcacctcatggctcagcaccaaggcccggggttggtcagaactcttaccatgagcctctgacctggctggagatgaaggtatgttctgtggcagacatgtcaggacagtcctccagccctctgctcctgatggttctgtgacattgggtctcttgagggcagtggagtgtcacacagctaataaagtacacatttcatgtt

SEQ ID NO: 235 - DNA, 2051 bp, Homo sapiens
agttcatcctgagccagctgctgaggcggcggctggggctggggcggctgtggcggcgcctggcaggctccgccagccccctgggagcgggggatgggctccgggcgcggagaaactccctcaacatccatctccatcttcccattcactggagggcaagacaaaagcggagtggagacttggcagcggcgcccggcagctactcagctgcccgtggcacgcatggctcgccgaggaggggccgcctcccgcgcgccctcccttctgccacccttcgcccccgctccccgcagctccgctcgcctgcttggctccggccctggcggcgtctgggccggggtgcgcgaggagcgggtggccgcgtgtccttggagcgctggccttcaggcgcccccggcagtcccgctaagcagagcgcatcccggcggcggcggcggcggcggcgcctcccagccgcgctcccagcctcagggccgcttgggtacttgctctccagcccggcccacgctcctagccgctttccagcgtctcttggggccccttggcgtttctcctccctaccaaccttctgaacaaagttgctggaagaaccaacctggtcgccgggctttgcccggcgaagctggcaaattccgggcaacagagggtcgatggggtaggaggaaggagaagcgagaagtcgctgccaggcatttactgcaatgtgcccggggcgggcgccagctgggcgccgtctctttttggtggtgagttctgtgctggaagagcgtcctcagcagggcagggctccaccaggaggcttcggtggtgaccccagggcaggcagtgcgttgcgtctataaatttaaatagagatggcgagggtagccttggaaattcttaaatcagggttcaccactagtcaggtgaacaggatgacttctcaatttaacaccacttgatcctgggtagtagcttacaacttcatgggaactgccactgcaactctgcacgtccaggagggactttcaagcagctctggagagaaatggcgggttatcaagaacctgttcaatattaaatagagcccattattctgggctttgaattccataatgctcccaaatggatcagcagattaatgaactattcatgcgtttcttggcagaggatggcttttttcccctagcatgtatcacagatcacacttgcttgatgaaactggaaaattgcattgctcatcccatgaatgctttgcattaacttaaacacaacttttacatatcaagacacactgtcccattgatgcagttacacaagaacacatcattaggttgtatccctcaatgctatcttttaatctgactctgcatgtgtgacagaaattaattgccactttcatcagtgtagacaaccaatctgggtaatgcaatgtgaacaagtttttgaaaaagaagaaaaagtttagggaccaaattacccattctctttttcttcagattttctaaaaatcagatttcaagttcgttttctaaattgggaattgttgaaaatagagtgagctcctccccagtacctggtaataaaccaacaatcattatagaacgtttataatggtaaattagattatatgtgtaatgtgcttagcagagtgtctttgtgcatatcgagcacctaacattgttataccgagaacagtaagatgatatatgtccacactgagtgttcatctgaagaccttgatttacaaaatagaagctaccggtttaaatcacctttatttaaatttcctaaaagatatttggtatctttagagaatgaagccccttctgaagacaggaagaaagtcaataatattttgtgcaataaaggtttgaatttgtcaggtttttgtttttttttttttccctacagtgtagcaataaaaatcacatgtcagttcagacagcagcaggaatagctgactggtaagttattattcttccatgcttgctacttccaaaatacgtttgtgaacttctttcaaggcttaaatgaagattaaatcaaaataaagatacaatacttcaatt

SEQ ID NO: 236 - DNA, 2126 bp, Homo sapiens
aatccagaggacggaaatcttcgagtactgtcagatgctgggccgccccaaatccttcatcccttctttccaggtgtataagctcctttatgcttcccgtctggcagattatggcctcgtgtcccaggctttgcattaccgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccagaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgacgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattaacttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcct

SEQ ID NO: 237 - DNA, 2036 bp, Homo sapiens
attgctcagcggtgctaggctggcgcggcttgagccgccgccggactgacagctcggtctgcggaccatggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgagggccgctgcagctgcagcgcgggattccaggagcgtggtgacttctgcgaaggtatccagttggctgggggccgtggggtgggagtgtagagcgtaggtggcaattgagagagagtgtgccctagaggaaagaggcgggtgtggggtcggggggcggtggagaaaccttggactctggagcccaaggagagccctgaagtcttgtggagtttccagtgagtccagtcagggccaatgagtgaacttactagatgaaattgactggctaaggaggcattagggatctatatcttaggcaccttgcacaggccttctcgtttatttattttcatggcaataaaggaagtcattgttttttttttttttttaaataaggagtctctcttgctctgttgcccaggctggagtgcactggcttgatcttggctaactgcaacttccacctcctgggttcaagcaattctcctgcctcagcctcctgagtagctgggattataggcgtgcaccaccatgcccagctaatttttgtatttttagtagagacggggtttcaccatgttggccaggctggtctcaaactcctgacctcaagtgatccacctacctaggccttccagagtgctgggattataggcgtgagccaccgtgcctggcctaaaggaagtcattcttatctctatttcacagatgaagaaacagagcctcagagagattagtaccccacttgcaaagttaggaaatggggagctaggatttgaattcaggcttgcccaactcacattctatgacatcatgaggtctcctcagtgcataaggaagaactctacagcagcccaatcttcaggctagtgggattggttgcattacagagaggaatctcccagtcacggaccaaatacttgcaagttagaggctggcaggggggatttttatgctggagagagggattgggaagttgcactagatgattacgaagatcacatcccactctctgaactacaatcactgtgctccctgggggagatccttcatgttgagggttttgctgggttctcaggctagtgggggcattaggaacagacctctcattctctctcttgcctgtggctttggatacagagggtgatgatggggttattaatgtgtgtacttaatatagaaagatcaaggt

SEQ ID NO: 238 - DNA, 1994 bp, Homo sapiens
aaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 239 - DNA, 2198 bp, Homo sapiens
gctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagacaatcccatgagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggcgaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaag

SEQ ID NO: 240 - DNA, 2044 bp, Homo sapiens
actcccaaacctgaggggtccccacaaccccccagcccatcttaacctcctcttcccccaagctatctggtgttggaaagccagcatctagtgtggaaacaagctttctcaccaggtaggccatccgctgtcaggaccattaggtaaaaacagaagtgacaggttgtaggaagtcgttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgaagcagcagcttaccttgggccgtgttctttctcatggcagaagcacaggaggccaagccctaccttgcaagcacaaatacagcccctgctcactttctgttggccacaacacatggccatgcctgacctctgtggggtgaggcagtgcatggccaaggaacaagcacagtccacacagggggctgtcactccgtgacctcagtattacaaaatggttctcaaggagtcgcaaaatgtgtggcagatcatccatgatttgtttcccgtgtgctttacgaatatcctgaaatttttaaaagctgtttccattagaagggatctgttggggatttgaggtgagatgagaaagaccctgcattccagcccctcagttagcagtggtgaggccggagtactccacacgggacagttttaggaaagtgctggaatccaaagtttctccggagggctatgcaaggcgctttggaaaggcgaagcctgggcgcagggagcccagccatgtaggtagaagcagcagacggtgagggaggccatccccacctggccctgccagggccctgactcagtgaaggaagctgttgggatacaggtcattcagccgggcaggaaagatgggatgaagcccagcaagttcacagggatccgggaagttgtgtggctggaaacccaggcagggctgcaccacagggaccatttgctggagatgcagcacttgccacagccaccaccactgacagcatgacacccacaaaaagggagcctccagctgcacccctgctgctgcgagtacttcctcagctgtcttccatgagcttaaggttaagtaccaggagggaggatatgattgggcaaacctcaggcatgtgttcattctgtagcttccagaacatgcgaggagagagcatctggctcctttgtctcgaggaggagggggcaggactctgccagaactcactcgataaaagattttcccaaaaggaagggtgttcagatgacaaaagtccactacaccactttccttggctatctgatgcacccccatcttcccatgcgcgcacctcagaaatcaggctcccacctgacataacacaaccatgcctcacaaaaagacagtggtttatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccactcctactgatgaaatatattgttttggaaaatataggtttaaaaatttttttaaggtaacatgtaatggatgtatagtcttcaaatggatgaataaatgtttttcagagttattggcttt

SEQ ID NO: 241 - DNA, 2257 bp, Homo sapiens
aaattgcagaaatgatagggcttacattagttttgtttttatttgatgttgaagatctttgagtcacattagaaacgatgagtatttttcatgtggcactaatgagttaattcatattattattttttgagacagagtctctattgcccaggctggactgcagtggcacgatcacggcccactgcagcctcgacctcctgggctcagatgatcctcccatcttagcctgccaagtagctgggactacaagtgcacatcaccacatccggctaatttttttgtagatatggggttttgccatgatgtcgaagctgattttagactcctaggctcaagtaatccttctgccttggcctcccaaagtgctgggattataagcgtgagccactgtgccaggccaatattattccccaaaagaaggaagttgggtgtgaggtcctgctcctgtggtcaccgtgaggttttttttttttgttttggactcttgcccaggctggagtgcagtggcacagtcatggctcactgcagcctcaagctcctgggctcaagtgattctcctgtctcagcctccctggtagctaggaccacagatgtgcacaactatgcccagggaatttttaaattttttgtagagacagggtctcaccatgttgcctgagctgttctcaaactcctggcctcaagcaatcctcctatcccaaagtgctgaaattacaggcatgagccaccacacctggccaccactagtttttgtaatgggagcaggttccatatgagatggaggaatggatttcatgattgtctttttaatttcttagatctccaagaaattggacatgaggaaaccactctaagtgtgaccactctaaagcattagcaatcagtcatttcactctagggagaaatcagagctgaaatatagaggataggtaaagtccccaatgtagatatgtatttttatatttgattacttgcttttttttgttagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 242 - DNA, 2325 bp, Homo sapiens
tttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtactaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 243 - DNA, 2319 bp, Homo sapiens
agtcatcatggacaccctccagcccggcttcccttctctctgaaatcctccctgctttgacaaaactgtcagggtctagccaagccaggctggccccaggcctatgcctcggccgtctcatcttgccacttccaggaggcgatgactctaaggaggaaagaaatggcgcttcctccccgcttcccccattcatgcttccctgaactccttcttcgagactagattgatattcattttagccttgtcagtctatgacgatacttacttctgaacacaaatcgagggagggagggagaagagtcacacacatctgccctggcctctcctgctccagggcagccctgcaccctatatgctgctgcctcaggcagagccctggaaaatatgtcatttgtgtttttggggaatgtttggacctacttaccctcctggaaatgataaaagttcacaaaatttggaggaagaagaggcgagaacgatccccgaaccgagcaaagcccgcgcgccgctgcatcctgcgcccagtgcctacgtctcaatgccatcgtcgccgccaccatgaccaagagaaaggctgaaggagatgctaaaggagataaagccaagacgaaggacgaaccacagaaaagatccgcgaggttgtctgctaaacctgcttttccaaagccggagcccaagcctaaaatggcccctgcaaagaagggagagaaggtacccaaagggaaaaagggaaaagctgatgctggcaaggagggaatagccctgcagaaaatgaagatgccaaaacagatcaggcacagaaagctgaaggtgctggagatgccaagtgaagtgtgtgcatttttgataactgtgtacatctggtgactatacagtttgaaatactattttttatcaagatttataaaaatgcagaattttattttactttttttttttaagctacgttgttagcacacagaacacttcattgttgtttttaggggaaggggcatacgtcactaatagaatgactccgaagctggattgatatggggaaaacacctttcccttctagtttttagagacttccttttggctcccaggaggagggattccctggctttgatacacatggccaccttggcacaaaaggcttgcggtatggaaaaacaaatttatttttatgtcctcttctccctttccatctttcagcatagacttaactcccttaagcccagacgtctgttgggacctgacccctagtcattggttaccagtgtcaggcaatctggactttccagatgccactgagatggcacctgtcaaaagagcagtggttccatttctagattgtgaatcttcagataaattctgccattttcatttcacttcctgaaagtcaaggttggtttgtgaaaagttaacagcatgctgaatgtgaaatatcagccctcactctaaactttccctgttcagagcatcagatgaagacttcattgggttttatactggctttctttttggtagtccactgaagaatccagggagtttgaaagttgttgtatactgttaatgattgtctgcccatgtcctgcctgaaataccatgactgtttatggaaagtatctttaataaagctggatacagtttggcttggaaaaaaaaagttcacaaaatttgcagcctgacaatgcaatagaaaaagaaaaactcgctcttggctttcggcttggaggaggccaaggtgcaactttcttcggttgtcccgaatccgggttcatctgacaccagccgcctccaccatgccgccaaagttcgaccccaacgagatcaaagtcatatacctgaggtgcaccggagatgccacttctgccctggcccccaagatcggccccctgggtctgtctccaaaaaacgttggtggtgacattgccaaggcaacgggtgactggaagggcctgaggattacagtgaaactgaccattcagaacagacaggcccagattgaggtggtgccttctgcctctgccctgatcatcaaagccctcaaggaaccaccagagacagaaagaaacagaaaaacattaaacacagtgggaatatcacttttgatgagatcgtcaaccttgctcgacagatggagcaccgatccttagccagagaactctctggaaccattaaagagatcctggggactgcccagtctctgtgggttgtaatgttgatggccgccaccctcatgacatcatagatgacatcaacagtggtgctgtggaatgcccagctagttaagcacaaaggaaaatatttcaataaaggatcatttgacaactagtg

SEQ ID NO: 244 - DNA, 2294 bp, Homo sapiens
ttaattttggtgggtacataatatgagtatatatttatgcacttatatggcatattttagtacaggaatacaatatataataatagcatcagggttaagtgaggcatccttcacccatagcatttctcctttgttttacaaacaatccaaacctacactttttaaaaattttttgttgttgttgttcttgttgttgttgagacggagtctcgctctgtcgcccaggctggagtgtgcaatctcggctcgctgcaagctccacttcccgggttcacgccattttcctgcctcagcctcccgagcagctgggactacaggcgcccaccaccatgcccggctaattttttgtatttttagtagagatggggtttcaccatgttagccaggatggtctcaatctcctgacctcgtgatctggtctcgatctcctgacctcatgatctgcctgccttgacctcccaaagtgctgggattacaggcatgagccaccgtgcccggccactttttataaattttaaaatgtacaattgttatttactatagagttatttttatggtcataatacaaattatatatgagtataaataaaattcatttctaaactattaatattttttccaaattgttatatatttttctttgaacatgtggcctgtctgcctgcaaacatgcagactttttgattcacatagagttaaatatgtattagtctaaagacaaactttaggtgtaagaaaattatggaataagtgtgtgtgtgtgagtatgagtttgtacctattttcagaaaagaacaatatgggaataaaaatcattttaataaggtggctactataaaactaaaaaccttaaaaaatgctgaaagcaaatgtatactttgtgctttgtattgaatttattactgtacaatccatgacttacagttctgaaccttttcatgcaaattctctgtatatacttgcctggtactcatgctagacccatactttttttgtttcttacattttttttgttttatggtttaggaagtattcattatatgagctggtctgtgattataagaatttttatgaaatttagtgcacacaaaataatttttagatgtaattccaaaagtagtgtattaagttacattttatttagtgagagcactccattttgttcttttaaggggagaacaatatataagttttcttttctttagtgattgttcctttcactttttataattgacataagtatatttatttattgagtcaatttgttcaggtaagtactggggggcttcataagtcatgaggatgtttttatatataaatgtagcaaacatacattacagttcttactgtgtaatcgatgctccataataattcacaaatattcctgctggagttagtttgtaatttcaagtcagaaatgaaagatatcagtggtgaagaaataagattgattcttcatatggagtggacattttttccagactataaaactgaatcttgctgaatttaaagagaaattctggccgaggcggatggatcacctgaggttaggagtttcagaccagcctggtgaaacccggtctctactaataaactacaaagattggctgattgtggtggcatccgcctgtggcccagctgctcgggaggctgaggcggaagaattgcttgaacccgggaggcgaagattgtggtgagccgagattgtgccattgcactacagcctgggtgacagaatgagactcataaaaaaaaaaataaattctgcttcttttattttctacttctcttcagatttgtttctcgtatgtattttccaactatgtatgcatcacagcccttctttttctgagttatagctacagttttctgactgttctcttcacgccatttcatttcacctggtattttgtagattttgatgacaaaattctatttttagtgcacttaaaaatggattttaactggtgagttcgcttatcaatataacattcagattagttaattaagataaaagccaggtgtggtggctcacgcctctagtcccagcactttgggaggccgaggcgagtggatcacttgagctcaggagttcgagaccagcctgaccggcatggtggggccccgtgtctactacaaatacaaaattagccacatgttgtggcgcatgcctgtagtcccagctactcggggggctgatgcgggagagtcgcttgagcccgggaggcggaggttgcagtgggccgaagttgcgccattgcactccagcctggacaggagcaagactctgtctc

SEQ ID NO: 245 - DNA, 2106 bp, Homo sapiens
atgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgttttt

SEQ ID NO: 246 - DNA, 3261 bp, Homo sapiens
cacgcgctcgcaccggcgggcaggtgagcaggcagcgccgcgcgctagcagctggcccccgtagacgccccagccgccgcctccgcctccgcctccgccggcgcatcgcggacgcccagcaggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttctactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgac

SEQ ID NO: 247 - DNA, 2130 bp, Homo sapiens
atctcggaggatgcggcgcggcgatcggctgcagggacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctggagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgttccccactcaggtactgtcaagaggccagtgctggaaggacagggtgggtttgaggaacacttccaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatgggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccagatgaagccgaggagtggccggggcgcccccaaagccatcccccagcacccccagtccaggccccctcgacgtcacgccggggcctcattcgagtcaccacgcagcgagccctgggccagcctccccctccggagcccaccgccagctccatggcttcagccccagcctccagccccccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccg

SEQ ID NO: 248 - DNA, 2774 bp, Homo sapiens
aatccgcagaagccccttggacgctaccgccgccggaggaacgaaaggggcgcactacccggggcaggcttcgcgctgcctgcgcgcggggcgaggggagcaccgtagcgttctccgcgccccggatgacgccgacccgcgtggggagaattcgcccccgcccgggtttcggccgcggcctcgcggccactttggagacactccctggctccggccaggcggaccgaggcgtgactcgcaggtgcccacgcgtgccagctgcggctgggctagggacgcggggtcgcccggtggggagcggggacctgactctcgtaattcgttgcaggatggaagggggctgtggtcgcgcgtgggaacccgctcgcggctcggcgggtctagggacttcgggttcctgaatgtcaaaggcgcgggcagctcctagagcaaattgcgggatttctttgggaaacgcgactggtgagcccttcccggctccagtccactttgggcgctggaaccactccccgttctgctcgcgcctcagtgactgtctacccggcccagggcaccgtggacaggaccgcacacgaagtagtcaccttccgctgcagctttggggagacaagcggaatcattttcttccagcgaattctaaaatcgttaggtgcaaactctttgagtgtcgcacccctggcctgggttcttcctcccgctccttgtggtgtggacagtggtgagagctcggatgtgctgttgttggccagaagtgtgttcaaatttggactggccatttcctcgctgagtgaccttgagaaattgactctatatatttagatttcggttttctcgtttgcaaaaaggaaaataatgcatgcatgcgggttgttcgtgagccgcgagtgagatattgagggagcgcagagcactgggcctggcacgtagtaggcactgggcagcgtggctcacctcccactctatccccccagagtaatggctgatgtattattgttgtgactcttgtttattttgttggcagtttaattttatttgcaggggctcagtacgttggagagaaaggtgtatttgtctaccagtagggtcagtttcagaggacggggaaagacaggaggtgcaggttggggattctttctctcttctcccaacaatccaaaggcgtcaggatttgcagggcctccaggcctgggtctggagttgggtcacttgcccgctgtgtgaccttgggcaaattcctggcccttgctaagccttcctggtgggtgtggagagggaggcccaacagtgaggagtgagagctgcaggatgtctggggtctgggcaagtgctccctcactcccttccagcgacaaggaccctcagatggggtagatgccattgccctggctccagggggcctcctgcttctaattcaggctctgccactggcagtgtgggtccctaaccgcccctcccagaaccgcattttccttatttgtaaaacaaaaagggcaccagctacccccagggtggctgtgagaacaaaatgagataacatctgtggcagtgcctgtgtgaaactctggcggttatatcataataactttaatgacaactataaagctactgtagctgagaccctagcctgtgccaggcagggaggtggacacttatttattcttcacaatgaccctgtgaggaaagggctgttagtggccccaatttctcactaatgagggaattgaggctttgagagttcaagggaagcacagctccccacttgggggctggagttggcacctcaccagctccacttcccttctggcttccagtgcccgggactcagggctgcccttgtcacttcagacactgttaaatcaggacaacaaggcccaccgcacagaggtttgtggcacagaattaaggcgtgggtggcacagcgctgctcccagcttgtgtgcttaagaatgggattcccacctcagtttaccagctgtggactcagggaattattcatcctctttatgcctcagttttctcatctggtaaataaacctcatgggattaaataagcgccccaggtaaagcctggcacgggtcagggctctgcttcactgcttggcttccggcttcctgagatccacggtccctcatcgtccagccctgtcatacagatgaaggagctttgggccactaattataagcctcctttcacttcctatccagatagctcttaggcagctcaggaatggggggaacttggttagtccctaggacagtggttctcagagtgtgtttccagagcagcagcatcagcatcactggagaatttgttagaaatgcaaattattggaccctcgccagacctacggcatcagacactctggggtaggactcggcagtctgtgcttaacaagccctccaggtgattctgatgcctgctcaactctggaagccagtgcccagaatatggtccattccatctgagttttcaaatgtgttgttgtaacattgtgggaagattctctcagaatttgcaactctcatacgaatctgtactaatgccttccacttctcattccccgtgtcgctcattcatgccttctcctgatcatacttgccaaaggtttgttattttgttggtttttaaaaaagcctttgatgtcattatccccttttaagatgccacctctttcgtgaatgttgcggtttaaaaaaagatttattccttctttgctgagttgaaaatttaatttgtcaattttctttctttttaaataaatgcactcaagggc

SEQ ID NO: 249 - DNA, 2092 bp, Homo sapiens
aggaaactccaaactgttctccataatggctgtgctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtaagaccaggtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaatagccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcctcaataaatttggaagagggctggcctattagttgtcataataatggttttgtaactcatatgaaataaaatcagaatgt

SEQ ID NO: 250 - DNA, 2824 bp, Homo sapiens
accttgaagaagctccggaggaagtgcacgacgctgagcatggtggccgccgggacgcccggagcccggccgcagcactacgagccgcgccgccgagccggctccaccgacgccaccccgcgccccgccctagggtccgcccccgcgccctcgcccggacgctccgcccccgcaaacctggccactggaggcacgtgaggtccaggctcctgccctgcccgcccctgggctttggtcacccgcgggactgggcacgcacaggcacacagcagagccgtccacagacccggcccaggggccgccgggatcatcccgcccagtcgagctcttgggcccccttgaagcctaggagtgttttctcagagagaaagcagcacgcttcttgcgcatttgcacatctccaacgcagcgcttcggcctgtcctccgcactggagactcaggtgcctccgccctcctgagagcaggggcggcctctctgctgagagttctgattgtcaagctcccagaactttcagagttcagtccgcccagcgttcttgtttaccagttgaggaaacggaggcccagggaggctgtgcagcgcgccggcactcacacacctggtggggacaaatgtggactaggatatctgggaccgaagtcttggcctccagctccctcttgcctcccacttacctttccagagatggagtttcaccacgttggccaagctggttttgaactccagacctcaagtgatctgcccgcctcggcctcccaaagtgctgggattatacatgtgagccaccgtgcctggccttgagttacattttcatggggacttgggacaatcggaaatgcatccaccacacttgcagactgactggtgatcctgaaatgatggcgtgtgggagaggcatgggcttcctttaagagccgccagagccagggcaggggcaccttgtgccttgacataaggaaggctcccctgccaggatagacagaagagctgccgaagaggtggagccaggcaggggccacaggcccgtgaaggtctcagcagagcccccaggagagttggacttgctgcaagcagagcctatggctctgcggttccaggagaactgtttgtgccccttgccccactgcctgccagctgtccccaaaaggaccagaggatcagagtagcccactccagacgaggtgcgggcaccatgctgttaccatctgctgcccctctttccatctttccatcttacttcctgcgtggcccagcatccaggctgtctagggccgtgggagacctggagagccattaaaaacaacaactggcagcacacaggcattttttggcagcacacggaaactcacacggaacagacagggagccggaggtgagcagagttacctgtatttctctcaccacctgaggaaattggggttcaaaggggtaaagcaccttgtgtgttggccccaggggtgaagcaggaggggccaggcctctaggaggactggcacagttgggtcaaggacaggggagccaagaatgtggggtgcggtcaggacctgggatggccaagcagtgtgaggtgagccagaggcccaaggtctctgagatgctgcacagaggggcattgaaaggagccaggatttgaggaggagaagggaggaggtgggggaggagggctcttatgcagacctggggtgtggggaggggatgttcactgacccccccgccccaccctcgcccgcaggaccgtggccaggctccaccctggaggcagcagagcgaggaacgtctaatggggatcccgtgtggatgcctttagggagctctgctgtatacctgttacctctcaccctcaatcacacctctggggcctggagctgctggggacacattgactggaaggggcttgggggcacaaggagtgagagccagagaagggcagggcagcccagggattggcagagctggcctcagaagctattggtgccactgagattcaagtaccccctgcttcttccccaagtcacagacagggtgaagacagaggcaggattcaagcccagagcccatgcactgccctcattccctgactggagtgtattcctggcagggtgacctggaaggggcccccccagcacactagctgacctacttctgcctggtctgagaagcctgtcctacatcactcaacctgaacacaggggaggcaggggaagaggcaggagggtcctcctatgaccaggaccacccccagggcccgtgctgcggcaagggcaaggacccctgcctcattgtgcccctgctccccacgtctgaacgtggacaggactgaggttgccctctgtaaggactgtggaggctccaggctgggagaaggtggaaggtcccagagccccggagcctggctctgctgcctaatgctggagcaagtcacctgacccgcctagcctcagtgttctcatttgtgaagggggctgatgatagtgccagctctcagagctgttgtcttcacccttggctttcagtgtcatggtcgtgaagcccactcatacgtgacctcaatgagatggccaggtatgtttatcagcacttttgggataatgattctcccctcccatggtgactgtgaggggcatgagtgtggccagcgtgcagccgagaaaacagatgtgagccctctcgtttaggaagggaaggtgggacaggcaggcaggactccctgtgggcacctgttgagggggcctcaccaggctgcatggcctcaagggctgctttcattgattcatctacagtgtatagttatttccaatcaactcaatacagcattcatttg

SEQ ID NO: 251 - DNA, 2558 bp, Homo sapiens
agtagaccgcagaggctcgcggccgcgggtaggctccctcagatccccgtagatctcagtagatccggcgtgtattccccacccgcggagtatcccggtgtgcagcgatctcccgagagttggcgcagggccacttggctgcagagaacgtgtgcaccttcagtccgggaaacccgccgcagccgagtagccgcgcatcctgggaagcctggcgagccacggcgccgggggcggccaaggggaggcgggatgagtctgcaagccggctgagcgcgccgaggagccggccggggcaccgccggggacatggcatcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcagggggtaactggcgcccctgcaacccatatccggcaggctttgagctccagccggaggcagcgggcaagaaacatgggcttctggagaagccgtgctttgcccaggaactccatcttggtctgtgctgaggagcaaggccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctaacactctggccccatacagcagaaggcagggatctgctgggagctgagaacagagccttgactggtgggcaacaagcagaggatcccaccttggcctcaggggcttatcagtggcctggctctgttgggaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcgcccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccggaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctgcagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggagttctttccaaggatacccttatcaagtgatgctgttcctctaggcctcagccagtttctgtttaacagtctctgctttgccttctgcctggtagacctacactcagccataggtgggagtgagacacttgtcatcctagaaaatggcaagaagaaaggaatacaaagaaacatttcattgcaaaacataatgtggagctctcacattaggatgaggctcattctactttgtgacttaaccagccgctttgaaataaaacagatctaatcctgtctcaccaccgagagactgacatgcaagtggacaatgcccaaactacatataataataaaactctatccaccacctctgtagcaaccagctcagagaaccaaccac

SEQ ID NO: 252 - DNA, 2483 bp, Homo sapiens
ttcatatatttagtagagacggggtttctccgcgttggtcaggccgttctcaaacttctgacctcaggtgatctgcccgcctcgacctcccaaagtgctgggatgacaggcatgagccactgtgcccagccgccgatatttctttaaattatgtttagggacagggtctttttctgtcacccaggctggagggcagtggtacagtcatagctcactgcggcctcaacctcctgggctcaagcgatcctctcagctcagcctcccgtgtagctggggctccagggacacacccccactgctggctaatttttgtatttttggtagagtcagggtttcaccacatggcacagtctggtctcaaattcctgggctccagtgatcctcccaccttagcttccagagtggccaggatcacaggcaggcaccaccatgcccaggtaattttatttttttgtagagacgtggtctggctatgttgtccagggtggtcccaaactcctgggctcaactgatcctcccacctcaacctctgccatagccaggacctcaggtgtcagccaccacacccacagctaattttttttgtagagatggggtctggctctgttgctcaggctggtgtgtagtaggggcacagtcatagctcactgtaaccttcaacgcctgggctgaagcaattctcccgcctcagcttcccaagtaactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccaggttcaagcaattcttgtgcctcagcctcctgagtagctgggattacaggcgcccgccaccgcgcctggctaacttttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctgctgaagtgttcaaaagttgtcaatcctcagccgttccctagtcctgttgcccggttctgccgaagccccttgaaggctgtggcctgggctgttccctcattcattcctgcctcccgagccaaacccaggtatccgcttgtgccctgcgtggtgtggcagcgtcttctctcgggaagggtcaggagtagtttcttctttcagtggcctctctgtgctagtcccggtcacctccgtgaattaaagtcctacaggtacaagggagacccccccccccacggaaggcgcccccagtccgtgtgggagactcgcacaccggttttctgcacaggtttctttctgcctctgaagcgtgaacggtcctagtttcagacgcagatcctgcaaatacttttttttgtttttttgagatggattttccctcttgttgttcaggctggagtgcaatggcacgatctcagctcactgcaacctctgcctcccgggttcaagtgattctcctgcctcagcctcccgaggagctgagattacaggcgcgtgccaccgtgcctggttaattttgtatttgtatttttatttatgttttgagacggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtc

SEQ ID NO: 253 - DNA, 2147 bp, Homo sapiens
tctgagatggatgcatgagcctgtctcacccactcactgctgaggtgcctgtctctccctaaggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccatcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagactcaccccagcccctgcctgcccctgaggaagaagaggcactcaccactgaggactttgagttgctggatcagggggagctggagcagctgaatgcagagctgggcttggagccagagacaccgccaaaaccccccgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcccccctgcctcatctctatcctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctag

SEQ ID NO: 254 - DNA, 2281 bp, Homo sapiens
ttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatggcaacctggagg

SEQ ID NO: 255 - DNA, 2462 bp, Homo sapiens
gatctcagctccttttcagctagtgggtggaaccccaggagggaaaactcagggaagcccaggaggaagtgaaaataccccatggagtgaagcttgtgtgctacctgggttccgggccagtgatccagctcctggggggcatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggt

SEQ ID NO: 256 - DNA, 2543 bp, Homo sapiens
gagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggggcttgcagaaaaggaaagggggctggcctaaaggcaagaagagaaaccccccgagggaccttgctgttccgtgttcctacgacagggtacatgatattcctgaatgagcagagaagtcagctgagggccacacaccccgatctgcctttcacagaaatcatgaagatgctggctgttcagtgggcccagctgtctcaggataaaaagggggagatgaactcaatgacctctactgcgggacctccaggcagctcttcagctccctgtgcaacaagaaggaacctgctgcaaaggcagcacctgcagcgcctctcaggtaaccagcctgggccaggcggctcagccgcaaacgctggccttgactccacctgcgccagaggtcaccaacaggcggcccacgtgacacctcttgttattaaaatgcaattttaagacagactctagtcaagcccacttaccaccaggtgggtgtttaggacagggtaggtcttccactatatctgttttcctcttagttcgccaggcccgcctgctctgggccacgcaggacacggacgtcagcttctcctggagcgctcgctcactttattccatctctacgagctcctcaagtatcccagagcatccccaggcctgtggccacttcgggtctggatgccgcattctctgacctgtggcacattctgggtgcccatgattatgatgaggttctgtgcccatgtggcctcagggctcttgagaccacccttcaaccaggtctttgctcacctgtctcctgcccagggacgccacccaggtcaccggtgcaaacctccagcccctgcccgtttctctccatgagtgcattgccacctcgcagcctcttccacttgctcattcctggtgttattgcctgtctcccactggaagagaaggccctcgagttcagcaactgttttgcctgttttgttcactgtggtgaaccccgggcctagaaccacgcctggcactcccagtaggtgctcaataagtatccaatgagtggacagatgaatggatgtgttcaacaaatgaccctagagcgtgtattccttccagggacagagcgaggtactggggacacaggaaggacgaggcagagctccgcgctgacgaaaccaagggccaagcgtgcgagtgaatacgaacatcctggcgttaaaacgtcttgcattctagtgaaatgagacccattggacacagagaagccccaccacaattgcatctgtgtaaaatcgagagaaagatcgtgaaaacagccatggcaggggaatttaaaaaagatcctgccacgtactcaaagcacctggagcctctggaggaagagagggacaaatgaggtcaagtcagaggaggaagctgagggccccgagtcccttctgctcagatgtccgcatccagagaggagttctgcttctctcaacctgtgtttcttgcaagagtttatctataaattgctgaaaaatgggtaatcaagttcagcaactccctggcatctgtgatgacctatggtttgtaatcctagtcagaatcacctacatagaggatataatattaatcagaacaaaacagaaaagtcgctagaggaataacaatagtaaaatttacaatcagatgaagaataaagttttcaatgaggcacagttctaagcacttcatacaaataacctgtcttaattctcataaaagtactgcaaggcaggtgataatatcatctccttctaaagataaaatgcagcacagagaggttaagtaacttgtccaatgttgaacagctagtgagtggtcaatctgagatttaaatccaggctgtctgggtccaagaactctgttcttcactacttctcaacaacatcaactatgtaaaatgacacacatacataaacccacatcaatggtaatggtggtaatctctggccggcaagatgaaagatgttatgcaattcttcagtcctttctgtgtctgccacattttccccaatggatagatgtcacttaaattatcagaggaagaaacaaactctattaaaaggaatttcaagggccgggcaagatggatcacgcctgtaatcccggcactttgggaggccgaggtgggcggatcacctgaggtcagcagttcgagaccagcctggccaacatggcgaaaccctgtctctactaaacatacaaaaaaattagccgggcatggtggcacatgcctgtaatcccaactacttgggaagctgaggcaggagaatcacttgaatctgggaggtggaggttgcagtgagccaggatcgcaccactgcactcaagcctgggcgacagagcaaggcttcatctc

SEQ ID NO: 257 - DNA, 1907 bp, Homo sapiens
gatacccattgcgcgccggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagcaaaagtctactgacccctgccctaaacacaaggagattggatcagtgttgtcattcagctattcctctcgtcggttcttctggagtgggaaaagagttaaaactgcgcgatgcaccgagagcactttagttgacagaacactctggcttcccttctggtcttactgactattcagagtttctcctgctttgaatagcgttggtaccatgcagccagtgctgcaatgaaccaggtgctttatttatattcatacaagtgttgttctactttatgacgacgctttataaggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggttgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacggaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatttcccactccacacactat

SEQ ID NO: 258 - DNA, 2736 bp, Homo sapiens
gaaaaggcagcagaggtccagcgacagggcaccaggtccatcaacagtgaaaccacgctggggacacgtaaggctgctgcaaccgcaaccaccctaggctcaacgacgtcacagggaggctgatgggagaggctcggacaccacggagtgcagcctcgcgcgcagcccacctgcagctccaggcagtgcctctgcttctccgagatctggctcttcagggcctgcttctccttcaacagcttctccagcgacagcgtggcccagtccagctgcagctcctcgcagcgagccttgagctgaggggatagggatgggacagttgcgactggctggctgcctgcccagcacaccccacactctcagggcagggttccctgggcctgcctcagccaacagcatgtgtgcttagggcacagaccccgtttctggaatagcaggctgaggatgcggaacacgcggagactggggccccccacggacagatgaggcagctccagcacccacaccacgatggtgggatgctcgcatgaccccacacctcgagcctgccagagtcgctccatgacacccagggccgctgagaaaccatccagccgaggggcccaggcctgcctgctgtgacgcgctcgacaagctttcacaggtggcgcaattcgtctgggaacaaaccccacaacagaggcgggccttccagagcctcccacccacacagaggacacacccgcccaggcagggcccctctggttccacgtccctgtccttgcgccgcggcacccaccagctgcaagctctggccgcggagcgcgcggttgtcctgctccagctgctccgactgctcccgcagctgctggttatgggcggagatctccttctgcgcttgaatcaggtcgttgtaggtcagcgccttcacacccagctggggacatggggcgggggagaggtcatgctggtggcctccaaggtgaagtaagcccccaggcatgaccacccctgcagcccagcccctgggacacagctggacagaggcatagacaggaagccacaggaagccataccgacggacatggaccaccccagcctgcgccccagctgccacctgccacctgccctctggggtccactacctcatccaatttttgctgaaacagcctcctgatctcctccttctgggcctggcagtggctgaggagctgctgagccgcacccaggagctgggcgttcttctcctgtaggacaaacagggcaggtgactaagggccagggcaggtgactgagggcccacagggagggcccacgccctgcctctcatgcttcctgaagacacgctcaaggacagacatgcctgaggggacccacaccgggctgagatgtcaagaaatactcaggccacggcgggaggggaccagctctgcatcaggttcactgcaaagaactctcgccagctggagggactgcacctgccaccccacctggactcagccagggcagcgcccccagccacgcagaggccggccaatgccaaggagtttatcccaaggcaataccaggggatggacttttcacatggatctgcaaggaagccttctgcagcgtaacagcaaacactcagtgtccggaggcccacctccaagggaagaccccaggagccactgacacaggacaaccttcagacaccagcagagaacagggccccggcccaggcatgctgtcagctacacagtgagcaatgcatgtgcatatatgctcaaagcacgctgtaagcttttttttaaaagcaaagccaaagtccaaaatgcaaaccagggctcagggacagccgaccttgtggctccaatggcttttggagttatctctgggccgccagaacttccaccccatagcccggccctagctccccactaaagcaggtcctcggagactcccagggcggggccccacagccgggacctcaggtgaaggaaatcatgtatacagtggtccatttccaggacaaactgccttgaattggcttaggtcagcaaactacagaagagacagcatgtactaggcccctgcttggatcgctgatgcctgcttgtcagcctcccctgcccccgcttcccccggcttagttgccctcacccgaaccaaagaagtttagcctaagatgaaggtttaccagcctgcaaaagagctggctttgtctgttcttaatcagcctgcccagctacttagatcataagtcaaatacttgaacagtccctgagctgactgggattgcaatgcacaaaatgcagcaggacaaccctaaagaaaacacctacaaccgggcgtggtggctcatgcctgtaatcccagcactttgggagtccgaggcgggaggatcacgagattaggagatcaagaccatcctggccaacacagtgagaccccgtctctactaaaaatacaaaaaattagccggatgtggtggtgggtgcctgtagtcccagctacttgggaggctgaggcaggagaatggcgtgaacccgggaggcggagtttgcagtgagccgagatcacaccactgcactccagcccctgccgaaccaataggcgacaactgggaagactgtgacctcacagtactcagcctttgaggaaccgggggagggacctgtgcactagggggaaggttgcttgttcaaactgtgctgggtgtgcctatcagacaccaggtcttgcaaaaccatgattaaaagtctcattttcgctgtt

SEQ ID NO: 259 - DNA, 2840 bp, Homo sapiens
tacatctatttaaggttacatgatattttgatatccattatgtgttgtgaagtgattaccacaaccaagctaacaacacatccaacacctcacctagacacctttctggtgtgtgtggtgagaacacttgagtctaattcctcagcaagtttcaagaaaacagtatgctataataattattattattttgagacggagtctcgctctgtcacccatgctggagtgcagtggcgcgatcttggctcactgcaacttctccctcccagttcgggcagttctcgtgcctcagcctcctaagtggccggggctacgggtgggcaccaccgtgcctggttaatttttgtgtttttagtggagatggagtctcatgttgcccaggctggtctcgaactcttgagctcgggcgatctgcctgcctcggcctcccaaagtgctgcgattataggtatgagccgccacacctggcctgctattattaattatagtcaccatgctgtaccttaggtctctggaacttttttcttttagagatgaggtcttgctctgttgcccaggctggagtgcagtggcgccatcaaagctcactgtagcctcgaactcctgggctcaagagatcctcccacctcagccttccgtgtggctggaattacaggtgtgtgccaccatgcttggctgattttaaatttttttgtggagacggggtcttgctatgttgttcaggctggccttgcactcctggcgtcaagcgatgctcccgccttggcctcccaaagtgctgggattacaggcacaagccattctgcctggttaaaacgtgtttatctgaaagctgaaagcttgtaccctttgacctacatcccccgccttcccctgtgccctcaccaccataaccactgctctactctgcttctacgagttcaattcttttttagattccacagataagtgaggtcatgcactatttgtctttctgtgtctggcttatttcacttagcataatgtcctccaggttcatccattccagaggggtgttttaaaagacaatcttggccgggcgcagtggctcacgcctgtggtcccagcactttgggaggccgaggagggcagatcgcctggggtcgggagttcgggaccagcctggccaacatggtgaagccccatctctattaaaaatgcaaaaattagccaggtgtgatggcggggacctgtagtctcggctgctcgggaggctgaggtaggagaattgcttgaacctgggaggcggaggttgcggtgagccaagatcgcgccaccgactctagcctggccgacagagcaagactccgtctcaaaacaaaaacaaaaacaaaagacaatgttgagtggtgggtcttctgctttaacccctccaacacctctgactcccgccttgtctccctccagccatgcgggttcccaccctccagcctcagcctgtccccatctgtgtccctcagactcagaggtgtcctccccagagacgcagacatgagcctctgccaccctgtattacagtgccctgcagtcaccgcctgcctgtgcatcccttgccatgctgtgacctcttgtgtctctgttttcttcttggtaaaacggggatacctcagagggcagctgtgcaacaggacaaattcacacacgagacactcgggatgctcctggcacacagacagggtgaagcatcccttgtccccattgtcaccttctctattagctcgggctgccataacaaagtgccatagactgcgcggcttacacagcagaaatttacttcctcctagttctggaggccagaaggccaagatcaaggtgccagcgaattcagtttctgtggaaattctcttccgccttctcactatatcctcacagggcctcttctctagacatgcataaagggagacagatccctgctgtctctctctttttttttttttctgagacgaggtctggctcttttgctcaggctggagtgcagtggcgcgatcccgtctccacaaaaaacataagagttggccgagcacggtggcacgtgcctgtggtcccggctactgggaaggctgaggggggagggttgcttgagcccgggaggttgaggctgcagtgagctctgattgcgccattgcattctagcctgggcaagagagtgggaccccatgtcaaaaatacaaaagatatgttgaagtcccaactcctgataactcaaatgtgactgtgttgggaacatctggagtccttacagagataatcaagttaaaatgaggtcattagtgtgggtcctaatccaacaactgacgcccttatacaaaggagaaacctggacacagacatgcacagaagaccatgtgaccatgaaggcagagatcagagtgatgcttctggaagccagggaagattgccagttaatgaccaaaagaagccaggagacaggcctgcaacggattctgcctgaaggctcccagaaggaaccaaccctgacaacaccttgatcttggacttccaacctccagagctgggaggcgacacaattctgttgttggctgcagtggctcacgcctgtaatcccagcactttgggaggccaaggcgggagaattgcttgagcccaggagtttgagaccagcctgggcaacacagtgagaccccagctctacaaacaaatataaaaaagtagctgggcatgatgggatgcacctgtagtcccagctgctcgggaggctgaggctgcagtgacctgtgatcgcgccagtacacttcagcctgggcaatagagcaagacctcatctctgaaacataaacaaaaaaaccaataaagtctctgttgct

SEQ ID NO: 260 - DNA, 1815 bp, Homo sapiens
aatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagtcttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagagtgtccagaggagagacaaaatgggaaggcaaagcttatctcccttggagttattttccaccaaatgtggcaaaattcaattcatttgcaattcatggatcaaaagataaacgaagttatgaagctctttaccctgtacctcagcatgaactgcagcaaggacaaaaacctgatttccgttgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatatttgtcaacattcctcatgctgtatgtttagatttgtgattttactatatgtaaattaattccttaataaaatactattataaaat

SEQ ID NO: 261 - DNA, 2713 bp, Homo sapiens
taaggatcagagcgcgcctgagcctttcgctgcggggatgggaggcactgaagatttgggggataaagaagaaacggagggactgtcctgtcttccttcccgcagccgcccctcctccccagtcagcatcaggcccgtacgccgctcatttcaggggctaagctgggagcagcacgcacgttgcctcagtttcctgctcagctcccgggactaccttgtgccaaccttccctgctcggagtatgaggcacaggccggggtaatcctccagcctgggctggggtctgctgaactcgcggagcgctttttcctgcccgcgggtgaagattccccgctggcgcgtcccggggcgccctgggctcccgcgcgacctctgccgtcgccctcgctgccgcgctccggtggccgcgcagcccccgcctccaggaaagccacagattcccgctgtgccagggagcccgcgcggccggcgctccggcctctccctgcagctggaaaacgctgctcccctcttcctccttcaggaagaccgccctgattgggccggggatgcggcacccccaagtttggagccagagcccaggagcgtttacatgtcaggtgttacgggtggttctgacttcggatagtccccaaatttcccacccttcctggtcacccttcctatcccaccccggcggaagggaaggttacggctcaggatagttctggagcctcctcttccccctctactcgtacctggctggctcgtggggcatcagagcttacctcacccctccctgcgtccagacctggaggaggccgcagggtcccgccgtccgcgcgctgggggcgcccccgggcggcggaccccgcgcgccccgcccgggaggacggcgacctctccgccccctcgaatgccccgccccgctgtcgccgtcggtccccaccccgccaccggcacacaggcgcgcagacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacaggtcagtgagggggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaac

SEQ ID NO: 262 - DNA, 3050 bp, Homo sapiens
gtgatgtgccgggaccctccctgggacagtccacgcagtggcaaaggctggacagtcaggaggaaaaccctgtgggcccggctcagtgccgtcagagctcaccgccacctggggtgggaaggcattctctgagccctgtgcagatggcagctggggcaggcctcctgcagacccaggtgactgacagggcggtgagggcgcatgcccagggatcttaccttggtcatgtgtggagggcctgctgccagtttccttctgtggatgatcctgggaccgtccttgcttggacactgttgacctgctggctccagcgtgggcctggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagcccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagttggagacagggccagcgccacacggagcccggcggcccctgtgagggagtcccacacccccagcagacggcgggctcccccatcctatggatgggccgactcggagcgctgcctcttagtggagcctgtcccccgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggccccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcccccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 263 - DNA, 3455 bp, Homo sapiens
cataggaatccaggtcccatcctctcctcactcaagggatccaaggctgcctcttcctcttccgtagtggtgtggctttgcagaagtcacttaagctctctaatcctcctcctcagagtgccagactgcagctgccacatggagagagagagggtctcctatgtttcctaggcctgtcttgaactcccgggctcaagcgattctcctgcctcagcctcccaacatgctggatcacaggcagtggccacctcgcctggccagttttccctttacaaaaactggaatgctgagccgggccacatcagtcttggctggactcactgcccacctctgggaccttggcggtggggcgggaaggaggacctcaaaggctcagcgagtccacccccagcccagccaccagcgccagcctcctcctccgcaacacccaggcccttatcaggaaaggatttgggttggtggggaggggtggggggaagttggaggcctcaggctcagcaaggtgggtcggagagatagggaagtgaggagggggctgcgggcccctgctgggcgggggagggcaatgggagggatgcccagaatgggcacggtgggggactttggccaagctctgtcctcgctggcctggacctcaacatgtttccaggacttctgcctcccatccttgccaggcaagttgcctgcacctttaattagcaagcagcagtttctctccaattcatcacggtcgctgtttaattagccgagcccagggcgcccccacccccagctctgcctgcctgtcctaccaaggccaccaccacctcagggtgtcccctgttaccaccccccacaattattctgctccccagagtgggggatgggcccggcacgcccagctgaaacctcaaggagattctgggcaccggcgcttgtattcaaggcattcagcaaacatgattagggaccgaggctgtgccaggctggctctgggtagaaccccggccggacatgcggggcaggctctggtcctgtccagccgctggagaatggcttctcccttgggaggcgctggcacatctctctggcttggtccctgagtgctgggaggaggctgcagtactcctgtgtgtcactcccaccccacatccggaaagggacaccatgtcttcctcttcctctctcttccagagcccagaaagctcctctgagaatgctggacctcaggacaggggcccatgctctgcacccggccctcagcagccagatcctagaggcccagtccaagctgtgggccaagggagcggggcgggctgaggcctgctttgtgtcggcagggtctggggaattgggagcactggcaggagcccatggtccggggccgaaccagcccccttctgtttccctgaagaagggtgaggctgagggccctcggaacagagcccctgtgtcattctgtgcagggccgggatagccactagtcactgtgggcagaagcaagaagcagaggctcaggctccatcccaagcctgtgctcctgctgggctgtgggaggtgtgacccttccactgtttcgtagactgagaacatggagggactggcatttgctgtgttaccctgtggtgccatcagcgtgttgtgacaggggcaggaggagtgtgctagaacccacccactctggtactgcccatctctgtggccttgggccagccaccaaaccgtaccatgccttagttcccctatgattcatagctgcttcatgggctgatgtgaggattaaacagcttactatgtgttgggtctggttttgtttggctttgttttgttttttgagacagggtctcgctctgctgctcaggctggagtgcagtggtgcaatcacagctcacggcaggctccgcctctcaggctcaagcgatcctcccatctcggcctccctgagtctcgctcttttgcccaggctggatggagtgcagtggcgtgatctcggctcgctgcggcctccaccttccgggttcgggtgattctcctatctcagcctcctgggtagctgggattacagactccagcataaccttctccaggaagcttttccagagcccccaggctaggaacctccccccaacccctgaactcaagccccagcagcctgtgcctgcgccatctccatcagagctgcatctctctgggtctctgggtaacaagtgccatttctttgttgttttctgtgtcccccaaggacaaagctcaggctggattcatctcggaattcccaacaccggggtagaactggctcatttcaatttcagtcaatgtttgttgaggaaaggagtgaagagttggacacatgaatgaacgcatgaaacagtccggagtggggaagctgaagctcaggcatcaggatccgggagaagcatccagtccaggcggacggggtggaaggttcagagcaggggccccaagtcaggagtagggaggcagacggcaagacctccttccatgaaaggaggctgggaccaggggaccaggtagtgcaacgcggtgagggggctgtcagggcgactgaccggaggagtcagaggcaggaggcaccaccaggttacagacaaggaccttctacaagagggaaacgtgtcatgggctctggagcccctgtccaggttcaaattgtgaccctgtgccagggacagcttctttgtgcctcagtttttcccataaaatgaggataataatacttcattcatgcctttttttcccctcaacaaacatttgttgtatgtctgctgtgggcccaggacaggaggctgagaaggagctgaccacagtggtcacacagccaagccctgctgctgagatctgaccccagttcgcctgtcgcaagttctatttgtgcctcgttgtctgcctcctggggctgttatgagggctgaagaaggggcaggcacagaggagacacttactatatgatcattgtcctcctagagtatcatcaccatcaggtggacttcagtggccatcccaggcctccacggatcaaccacaagatcttggagaatgtccttaccctccaagcctcagtttacctttagggtgaccaaccatcctggtttgtccaaaactgagggttttcctggcacagtcccaggcaaactgggatggtgagtcactgatatagtttgactctgtgtccccaccaaatctcaccttgaattttaataatccctaggtgtcaagagcaggaccaagtagagataattgaataatggtggcagtttcccccatgctgttctcatgatagtgagtgagttctcacgagatctgatggttttataagcagcttccccctttgctcagtatcactctccctcctgccgccctgtgaagagctgccttccaccatgattgtaagtttcctgaggcctccccagccacgcagaactgtgagtcaattaaacctcttttctttataaatt

SEQ ID NO: 264 - DNA, 2819 bp, Homo sapiens
atcattgtctatgatatctgcaatggaaatgatcactaggcaatttcagccttgcaaatctaacatccagataccaacctcaccatcgtctgactactatgtccctggtgcacaatgcctgccttcactacagcctttcacacaaagtatttaccctgttgcttaattgtctgatcgtcccactcccttggatgagaactgcatctcttccatctcttattctgagtggcttggctaagacattcactgactccatggggaaacttcacctacagaggaaagagccatcctcctgtgggcaggtgatgtgtccttgttctttccctgacgtgcccagtcctcttgcaagtgacttgaaaggatgcaccagcctggctgcaggcagaggtgtgaagaaggtccttgcttccccttcaccttctgccatgattctaagtttcctgacgcctcccagccgtgcttcctgttaagcctgtgaaactcctttggaatgagtacacatccaggagtgaagaagacaagctcaactgccattctctgagcagttcaaggcatactgagttgcgggagttgtgtggtggtccactctgactgcaagcacccctttcttgaaccgaacagagtcaagtggaatcaaaggacattacctgttgattcttgggcaaggcccagaatttggtggacatacttaaagaagaaaggaatcttcagctaaagtgtctacgatcaattcagatttggagggcatggatcttctgacagtaggggccattctaggattttttggttgaagagatgaacttcaacttggttccagatgggtggtccagctattctgctgacaacatttttcagggcaaggcttttgctactggaatgatttaaggaagatccctcagtgtttcagagtaaagatatttctaaagaagtacctgtgtcattgcccatcttgaagattgacttttatggattgctcaaatactgatatcagctcaatgtcaatatatactcctacatataaaatccatcttctaatcataatcactaggtggatattgttatgcaaggaagagatgtgaatatacaggaaatgagatccttaaaggggttgccgtccagatgttagatcaaagagattatgattcattcaaccaagtcgctggacttttgaaggcctatccaagtcatggtgcctttgaggttgcgcctgttactattcaaaacttggtatgtgttattccatgtaaatgttatgcaatgattcaaaaatgaataccaggttgaaagatgttataacagccccttgttccaatgaactctacctttgtgagcaaaggtgaccaaaaagaccacactgcatgaccagcagcccacaaaccagactgggctaagttctgctgctatctctagagcttgctgctgttcaaagcactccttgggtccagccagattgccatactttcttgatgtatttcccatggctgcttcatttgttgttcatttctcttagtgcttttagtaggttattgttttaggtggcgtatctgtacctcctcataaaagatttttgggtccacattttccactcaaaatcatagtagccatgatgaacacctggcatcctttggacaactttccataactacataataatgagccagtttttaccatccatattagatatggctagagtgactattttctgaatcaaaattgtgctgagcatttgccaaatatcagataaacttaaagccctagaagtatcttagaaagtccaaggggagtgtcattgttctagacttagttcaaaagatgctagacaatggcgtccaagttcagcctttgtagacatatagagtgaacattacccttgctgttataggttttattctccactgagggccacagagcctcaccattggtttgccccacacacaacagggtaaattcctactcctttgtcaattaggaattttccaggcaatgtgtttacctcttgggtaaatacattactttcatcagtgtaacttaactataaagtatttttagaggatcagattatttgagtatggctgtgataagtctctccttaaatggaccttaacaaagtagaaagaaaacgttagcagacatttcagactaatgatgttttctttttttcaagtgggttatttagagttgaatagcaattacttaaagctagtagcaaaggaacattttctgtaatgatgtttatttatgccttttcattctataacattcagcatgtgacaaaggaattagagaaaagactagtcgaatctggagccatgcaattaatgaaatccatatgtttgaagaaatcgtcttatataactcccatgcttctgatatttcctagaacgtcttagattgaggtcattgtgcactattaacagagtcctggttaataatgtacaatgaccttaattcagcatgtttttaatgaatagctgaacttcatgcttataacatcctgactatgcttacaaatatttttctaaattgctggtctgtttgcagatgcattatcagtgcatgcaaaaaataagattatgcctcgtttaggattctctttcttgtaaagtccaatcactgctgcattaagataggtatgggaatgtgtaggcaaagtcacatatagtgacacacattggataaaaaatataaacttcagccacatgattctttcactcaaaaacataatgtggctctcctttatatctttttttaatgatttgcatagctttccattgtgtgtatgtgctataatttgttttaataaacccccactaattgat

SEQ ID NO: 265 - DNA, 2551 bp, Homo sapiens
atatacatgtagtgaatgtggaaaaggcttttcaatgaagcactgtctcatggtacatcaacgaactcatacgggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaagagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacctcaacagattgagagagttcacactggagaaatactttcctctggcagtgaatgtggcagggttttcagtaaaatgttttgcctcatcgtgtgctaggaaataatgcagaaaaaaactaatgaaaacattcaatgtagaagacttttaggaaaacaacagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttagttctaagtttgtgttatttcagaataactaaagtacttcagaatgaaactggatacagtatattcaattcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcatgaatgcccttaacccagcttcttccaaagataacaacttacataagcatggttcgttaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacac

SEQ ID NO: 266 - DNA, 2689 bp, Homo sapiens
cattttcccttggctgaggaaacgatggtttggttttgcaaaggaatgctggggacttctgccagcttgctaacggccttgccccattcagatgcatcgaactcacagaacatcgctccccagctgctggctcgcggttctgagagtgcctgaatagaaaaccgctcatttcccttcgcaaaagaggcgcccaaagcagatatttcaatatattccaatttagccgagggaagccagaacatggatgttgttgccaaggaaaccacctccttcctcctgtgtgctgtgcatacgtgtatcacttcatctctctgctctccaagcttgaatctagatctgacgtggatatcctgccacagttccgaagtctacctagtgccccagccgaacctgccctggctcctaggtggggtatggacatctgtgacatccctccccaacaccccaccaagctgggctgcaagacgggttatggtggccccatgacttccttccttggtaagccacaggacttccttgttaactgctttgctgttggtcattgcagagaaatagggaacaataaaaacaacctgaggtgtggcaaaggctctaggactgcatcatctgctgaagctccagtccctgcgctgcatctcctgagtggcatctgtgatggcaaacaaaggctccttgggcttcacgctctgctttctttctaagtggtacttaccacccgctgcatcccagccttcttctgaccagcttcctcttctgataggcttatttccatgaagtttttcagagttagaagcatgaactttagaaccagatgatcccggttggaatccatctctggcacttgctatatgaccttggataagttacttaacctttctgtgtctcagtttctttttctataaaatgggcatattaaaatctatctagcatagttattgtaaggattaagtaagttattatatgcagagctcttggttcacagttagtgccatttaagcctttctgtcattcttactgttaccattttcctggcatgtcagtctgatgatgcagacgaggcaggaactttcgtctctgcctctcgtggactgcccgatcagctccacggaactcagccatgcctgcagtgctgcaggcctcgctttggactgctggaggctgagaagtcaatggatgttgcttgggcattttggggggtttccttatgcaggaggaagatgacaatcattgtggaagcagaaggttgtcatggaaatgcacctgttccaagtcattgcaccctgggctctgggctggctctgcacgggcctgccatgcactgacttcagcttcatctgagtcagtggaaggctggacaaaggtagacatctttcctcactgccagcctgccattgcggctttctgtctctggtgtgaacaggcaatcgagctttcctggtctcctgagctactgtgaacgtggcagaagatagtggactctgaataacattggaaacaactacttcctggacggccactgtgtgcatggcctgcgggagggtgagggcaagaggactgatggttactgggaatcttcttcatggccaggcttctgtgtgtcctctcacttaatcctccaacagcactgtgaggaaaatacagcatcccacctcacaggcgaggaagcttaagttgaaggaatgttaaattgcctgctctgagcctcacagccgggaggtgacagccccaggattggcggccagggtttgtctgcctttaaaacttatgtcatgtccttctgtgttatctcggtctgtacaggctgctacagcaaaataccatagcctgggtagtttatgaacaacagaaatttatttctcatagttctggagcctggaagtccaagatcaaggctctcgcaggttcagtgttcggtgaggacccacttccttattcatagacgtccccttctcactgtggcctcacagcaaggggtcagggttctctctggggcctctttaaatagggtcaccaatcccattcatgagggctgtacccccatgacctaatcccctcccaaaggccccacttccccataccatcaccttgggggttaggattctaacatgaattttggggggacacaggcattctgatcatagcatatgtgtagttgctcctggcccgctggggaaatcaccgtctccaagcatggctcccatctggttaccctgggtggccaaggtcagcagaggtgctttgccaactgattggcacccacactacttctgtccaggtgggctggggcgagggttgggtcacagtgggactctgtggggctccggggactgtcagctgccccggggctggaggtcctgctgctctgtgcccataggcacctcctgggaatctggcgacttgcatcagggcccggaactcaccctgacagttctttcagctcttgtcttttcctcccctacctacctgctcatctcgctttcacacacaaagcctcccctgcactccccgctcccctcctcaatccctttcccggcttttgtactttatgatgccgtgacttgggtgaggaaactcattaaagtcattattccgtgcacagaaatgtgtctttcatcccattcatatttaatgttcctcccacttgatcttttgatgctttttaattcttgatattacatgacatacacac

SEQ ID NO: 267 - DNA, 2798 bp, Homo sapiens
gtgtgagggtctttgagggtctttccccaggtaccagctctgacagcctgcccggcaccttggttcttggcaggggtacttggaggggcgcagtgggcgagcagcaggcgtgctgagcactggcagtgcccaggtcggcctggaatgagggctgcgcttccagaatgcccagggcgctggtggagaaccatgcctggtgctgtcagctgtgcttcactggctcctcatggcccacaggcacctcacccactcctgcagatgagccaggggtccacagagggataagccctgaatgcccagctgcccccgggacaaccatgccacagagttacaggaagcaagggggccgcagaagcccctctggtgggggcgcctcccatgagtgtgtgtgctgaccccagattggcagggcccaagtgccctgtgtcctggctttcaagagctcaggtgtgccccctccaaggcccagccatagcgatgagagcctggtgtccagctcttctgggtccgccccactcgtgggccccgggtggctgttcagtctctggtttagtaacagaaacgtctgtttcgaggaaagtgtgcctggaactctgcacatggcgtggagcagagcttcagggtcacgctcccgtgagttttgccacagcctggaggtggtttctgcctgggctgccagtagagctggcaagtccaggagtcacaacccttgtccctctcctgccaatgtgggtgggcccactgaggcctcagttacagctacatcagagcggacaccacgtcctggttccacccagctggcggtcaagggcccctctgtccagacaggagagaagcagggagtttggaaagcagagagcaagaggtggctggtctcagccctgtgacctgggccaggcctaggacgcccctgagcctcagtgttctgtctggacgagctgccctcctgcccccaccaagccctgatgtcaagccctctccctgcagggactgtgagagtgtctgcttcatcggccggccgtggcgtgtcgtggatggccacctgaaccttcctgtatgcaggggtatgatggaggccatgctgtaccacatcatgaccaggcctggcatccccgagagctccctgctgcgccactaccagggggtcctgcagcccgtcgccgtgctggagttgctccaggtgtggggccttcctgggttcagcagggtgtggaggcggctgggtgcactcagtggcccggctgtgatgttcaggccccaggcaacatgcagtaccaccatactgcttgcctgcacctcctcccccagcttgtcctgggctcctgcctctcaggctgtccctcagtgtccttcaccagctccatgctgctgaccaggctggaagatggggtgcccggggtgcttgtctctgatgttttctctgtgccaggggtcactaactcatgagtccgccgggccccacgggtcaagcagctgccccctggtgcagctgcttcctgcttggctgactcccatgtgtgcctggggcctccagctcctctggcagctaggagcttgaagttgagtgtcaaattccccatgagccaaacaaaaccccacctggaagccagtcttggctcacaggaagctgggatttatcccgcgctgcaggcctctcctccacaaatgagattcagcgtggtggctccagccagcgctgtacacgtgctgctcaggcagctgcctctcccaccagggcctttgcctgaaccctcctggtacatccccatctgcctcatgcccagttcaggtgccccctgctctgggaagtggctccctggtacagagggggcattccataaatgcttgaagaataaatcaacaagcaggcgagggcagtgccgctgtaacctgtgtgtctggtgtctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcatt

SEQ ID NO: 268 - DNA, 2702 bp, Homo sapiens
tttgcctactttcttggaagctctccgactcttgaagggccctggatctgctttggagatggatgggcacggagcatttgtgacccccagtgctctccctggcatgttgggcttattgtgttgggagcagcttctccgccccagcggcctccactctttaatggggaccttgcttgtgaactgcctttttcccccaagccctgggctctgtagcccccttggcaggcgggcttgggtgggggcaaggggagatctgtgtctgcccggaagggcattgtgtagagcatggggttgtgggtgacattggcaacaacaccacttctctgctctgcccatgcctctccctgttcctgttttgggtttggggacttgggattatgcgccgctctctcttctcacaccgatccaccttactgcatctgacgtgttcccttccactgtcccccatcatcgtctgtcccccctggctgggcgcctgtgaccggtgacccctctaccacccaccccgcctccctccggcccccgctccgacacctggcttgctccgaccccccctgccccccgacagcagcacagcagccggagagccaagagtgtagaggacgacgctgagggccacctcatctaccacgtcggggactggctacaagagcgatgtacaagccaaatcgtaacaatcctatagcctgtaatggtcccatagccatcctaacgtcccaagccaacctgagtcacagcctcttgccttttctcagtggtgttgtttatctgggtggtttgagttgctgttgagaattgacctctgttgtccactcccagctctcacggcccctgggttaaaggtggtgggaatcacgcaggggttttcttcccctgtgaccatctgtatctgttccccttccttcatctccaccccaggttgctgtccccttttttcttccaactcagctcattccccaccttctctccctccctctccccgaccctgctctctttcatttcagatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccaggtaagtgatgggatgtcttacttgactgcctggcattcttctacctggttcctttgttttctgctgaggacccgcctactcagttctccacattgcctgccttcctggcagctgatccttagcatgcccttttcagtcccatgctcagttctgtttttgtttcccagacccatgacaacagagagcatctagccatgatggaaaggatcttgggtcctatcccttcccggatgatccgaaagacaaggtgaaccttgagggggcactagttaactcttttccttttctctccacagaattggtctatttcacatcattttcttttttctttgatacctcctctccccccagttactttcagatggggaaataagggaattgtaacaagggtgaccttctgattcctcaacctccccttcccctctagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttc

SEQ ID NO: 269 - DNA, 2549 bp, Homo sapiens
attttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcctggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtccggcaggtcggggtcaccagagccccaatgctcagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctctgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcagctgtttctaaacccagacactgtttgtaatagactggaaataaaatgttctttcctt

SEQ ID NO: 270 - DNA, 2526 bp, Homo sapiens
gcgatggggtgctggcctgccaggagcacagatacagagctagagcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctccgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaggttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtg

SEQ ID NO: 271 - DNA, 2669 bp, Homo sapiens
gcacttccggcagcgccggggagcagtccgctacggagctccagcccttctctgagacggggaccaggggatggcagccatgcacctgacagcctggccccagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaatcaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacaccagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaagg

SEQ ID NO: 272 - DNA, 3053 bp, Homo sapiens
taatctcgttcgggcctcggggtaatttgtttagctgtgctgatcagctgaaggttaattcaattggacttgggttatttatttgtgcccggatttgctaagtgtcattggaggtacatgaggtctttattatggcggcaagatggcttcattagggtgagggccactccctccggatccgccccctcccgccagctccaggctgaggcagtcttgggaggctggagccctgggaggctggagccccaggtgcagtggctcttgttcctggatgcaggggatatctgagcactgtgctgggagtccagcctcgcccagctctggtgttgatactggacggttctgtcacatgacctatcctaaccgaggctgaaggacctgcttcccaggacccgtcccctccctcagggggacctaaaggcgttttccccaccctgcctcagtgttcccattcacacattgggaacagcaccctgttctcctgcggcctcccaggctgggctttgtagctgcagcccccaccccgcctggcgaccggggcagaaggacgctgaggtcgcagagcgggcagacgggttggccgggcgggcagacctcctgcacggagccgggatccttctcaggcagcggcagatgatggattgcacgtggacactgcctgggatgcgtgcgacttggcagcctgcccctttcctgccctgggatcagacgccctggcgggtgtccttttcctggtcccctgtcctcctagcctggggcggcgtctggagcggggaggctcacccctgtgcccacgtcctcaggccacctgccagtccctgcccaccccggccgcggaggggctgtggagactcagggagttctgggatggcacagagggcccaggctggtagcaaccaaagccgtgggaaatgtgggagggatggcaggtgtcccccgaggagtagcccaggtgccccggaggctgctgagagggttgagagtgcagagacgaggggcccagggaagtcttggattctctcgccatcttcaatgtcggagcccagacggggcaaggcgaggaggagcccggggcgaagacgccacccacattcctccttcccgcaggcttcttctccttctagcccttccaggagagaaaccatcccacaagtccagagtagtggcgtccccggggccatgtctcctgagcaaacactgttttctaggagtccgaggggcctcagccatctaggtcaatccctttgcagaacggtgaaggaatctgaagcccagagagggaaaacaatgcctcctgggtcacacagcccatcaggggcagggcagggacgaacggcgagaaaaggaccagcgcgagaggagatccccagcagtgattcctcagccaagcccagcgtctacccacatccacacctcacagccacctgatggggaaggcaccattgccccttttcaaaggtgagaaaacagaggctcagagaggttcagcaacttctcccacagctacttcgttgtagaactgcagttccaggtgtccccgagctctcccttcccgagccatctgctcctgccctcctatccgagccctggccctcccagtcaaagccgggtagtggctgttcagaagccttggggctagtcaatcccagctgtctcggaccagggccccccccaggaggagaccctgaaggatgcagttgagaatatgtgctttctttggtaggtgatctcaggaattgcaggggaaagagggggagcgtgttagtgtaggctctccggagaagcagaaccaacgcacagaggagatttaggatgaggaatctggtttatgtgactctgggggctgagaaggcccaccatctgtgttgcaagctggaaacccagggaagcctgaggtgtgattcaaactcagctcaggtctggaggcctgagaaccagggcagccgatggtggacatccagtccaggggcaagagatgacgagatgtcccggctccagtggcgaggcaggaaatgaggggtgaactcctcctccctctgctgtctgttctattcaagttcttgagggattggattatgcccagccacttggggagggcagtccaccttcctgagtccacaattcaaatgctgatctaatccagaaacactctcacagacacagtgtgtagtctgggcaccccacagtgcacttaagtggacacataaaattaaccatcccagggagtgagatgggtaagggaagatgggccacagtgggtgtgtctccatgcctacccccactgtgggcagctgctggagcacacgcctcaaagtcttccctgagggagagggagctgaggtgtttatatcccagctctgtcaggcattggctgaatgtccacactcctggatcaccgcctctcatcctcatgatgtcccatggtcctcatttcacaagtgagctctgggtacatggggagcatcagtcacaccctgggtcagtacctcagctgtctctcacatgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcctgcatgacagctcagggctcccagagccactgtcccaagagatagaaggtggaaactgccagtctcttaggctaggaccagaaaccagcacccctgcacccacagccttttggtagtgatgaaataaacataagatttatcattttaatcattcgtaagtgggattaaatacatttacaatattgtgtaaccatcggcactgtctatatctaaaactttttcatcatctgcaataaaaactctgtatgcatt

SEQ ID NO: 273 - DNA, 3743 bp, Homo sapiens
tttaaaatatttatttatttacttaaagatggagtctagctctgtcgcccaggctggagtgcagtggcacgatctcagcccactacaacctccgcctcccaggttcaagcgattctcctgcctcagcctcccgagtagctgggattacaggcacctgccaccacacctggccaatttttgtatttttagtaaagaagaggtttcaccatgttggctaggatggtctcgatctcctgatctcgtgatccacccacctcagcctcccaaagttctgggattacaggcatgagccaccatgcctggccaatatttattatttttattttttagagacagagtctcactgagttgcccaggctggagtgcagtggtgcagtcatagctcactgcagccttgacctcctgggctcaagcggtcccccaaccttagcctctcagagtgctgggattacagatgtactccactgtgcctactttttaaaatttctgtagagatcaggtcttgataagtttacccttttaaagcgagcagttcagtggtttttaggccaccacctctaattccagaacattctcatcacccccaaatgaaatgctgtccccatcagcagtcactctgcatccccttccgagccccggtgcccacacctcccctccctgtctctgtggatgggcccgtcctggacatttcacagaaacaggatcacacgccgcatggccttctgtgtccggcgtctctcactgagcgcgacgtcctcaaggtgcatccgtgctgtggcctgtgtccgagcctcgtgccttttcttggctgaataatatcccactgtgtggacatattactaatctaattctaaacagttaattagaatattccagagttttcataaccgtctcccactgctgggcattcagggtatgtccatttttacggctgtgggaagcagtgctgggagtggagtctgtgtggtctcctggggtttccagctccctgccccgggtggaccccagcgcctcactgacagagccggaatcaggcgagggtgaggctcagccgccccatagacaggggctgggtgttggcactgtggctgtctgaagtggctttttgttgacacatgtgatctgacacatcccagccccgggaatcggtggtcaggagccccctcgggaggggagcacttttccccgagttatcagccacgtgtgagcttgcgccccactggtcccacagaggctctgggagcctgtgcgtgtttgctcattgcttctccgtgacaagttccagcctcgtaggtgcctggcctgcagttgaaggcgggtggggatggggcgaggcctcgtggagggagggtgggcaggcgggtcttcggcacactcccctcacggtgcctccccaacagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaggacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 274 - DNA, 2162 bp, Homo sapiens
catttatgatgatttagtcttagaaataagattaaatcctatcattttcactgcttaccaccctgtagagcttgtcactcagatatgcttaatgccactatctctcaagtaatctaggaacttctgacctattaaacattctgcagtttagaaaaactcttttttagtcttaacaccgggtggcttgcttcagaatatttcctacatgttggggcttatcccatgctgggttttccttgtggtcagaattttatatactgtagtacttttttttttttttttttgagacagagtctcgctctgttgcccaggctggagtgcagtgatgcaatctcagctcactacaacctccacctcccgggttcaagccattctcctgcttcagcctcctgagtagctgggatgagaggcgtccaccaccacgccctgctaaatttttttgtatttttagtggagacggagtttcgccatgttggccgggctggtcttgaactcctggcctcaggtgacctatccgtctcggcctcccaaggtgctggaattgcaggcatgagccaccgtgcctggccaaaaggttaatttttaatgagaaagccaatatgtatttcctaactagttccccttccctgggaacagaacacagtgttattctggaatgttatttggaaaatattataatttattgttgtggcttgatcaggatgtatccaagaaaaactgtcctatgaagtgtgatgcttttatcctcgtataacttatttcctctgtcaaatttctgccttggcactgccatatcaccccttcataactcataaatcacccacagtcaatcttagttgacataaacagttcgctaatggtaggaattcatgttttaagtagatatactattcttaagcatattttcagttcaaaacctgactgatattttggcctgagacatcaataaaatattgtgaaagtagagagcatagaaaaaaggggagctaactctttacaaaactgtatgctggcccttacagcagctagaatgaaatgttgtcactctcacttccataaacttgccaattgctgtttttctttctctgtagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattctttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctcc

SEQ ID NO: 275 - DNA, 2454 bp, Homo sapiens
ggtcacaacgtccttcaaggcattcattcctgcaatttttttttttttgagacggagttttgctctttttgtccaggctggagtgcaatggcggggatcttggctcgctgcaacctccgcctcccgggttcaagccattctcctatctcagcctcccaagtggctgggattacaggcatgcgccaccatggccagctaattttttgtatttttagtagagacggagtttcaccatattggtcagctggtcttgaactccagacctcgggtgattcacccacctcggcctcccaaagtgctgggattacaggcatgagccactgtgcctggcctgcaattttttttcatgaccacaaagttacctcttcctgcttgaccaagaaacagcacatcagcagtttatattgtgggaacaaggaatattgggcaaaaagtgagtggttagcacgtgcaagcaagcatcggcctgatcagaattttttttctttttttttttctttttgacagggtctcattctgtcacccaggctggagtgtgaaggggtgggttgcccctccacacctgtgggtttttctcgttaggtggaacgagagacttggaaaagaaagagacacagagacaaagtatagagaaagaaaaaagggggcccatgggaccggcgttcagcacacggaggatccccccagcctctgagttcccttagtatttattgatcattattgggtgtttctcggagagggggatgtggcagggtcataggataatagtggagagaaggtcagcaggtaaacagtgaacaaaggtctctgcatcataaggtaaagaattaagtgctgtgctttagatatgtatacacatagacatcccaatgccttgaagagcagtattgctgcccgcatgtcccacctccagccctaaggcggttttcccctatctcagcagatggaatatacaatcgggttttacaccgagacgttccattgcccagggatgagcaggagacagatgccttcctcttgtctgaactgcaacgaggcattccttcctcttttactaatcctcctcagcacagaccctttacgggtgtcgggctgggggacggtcaggtctttcccttcccacgaggccaaatctcaggctatcacatagggagaaaccttggacaatacctggctttcctaggcagaggtccctgcggccttccgcagtgttttttgtccctgggtacttgagattagggagtggtgatgactcttaacaagcatgctgccttcaagcatttgtttaacaaagcacaccttgcacagcccttaagccatttaaccctgagttgacacagcacatgtctcagggagcacagggttgggggtagggttacagattaacagcatcttaaggcagaagaatttttcttacagaacaaaatggagtctcctatgtctacttttttctacacagacacagtaacaatctgatctctctttcttttccccacaggagttcagtggcatgaccagggctcactgcaaccttgatctgggctcaagtgatcctcctacctcagcttcctgagtagctaggaccacaggtgtgcaccaaccacacccgactaatttttgtagagatgagatcccactatgttacccaggctggtcttgaactcctgggctcaggtgatcatcctgccttggcttcccaaagtactgggattataggcttgagccaccgtgcctggcctgtgatcagaattctcatttttttagtcactaaaaatgctggggggcactccattctccattatgtgattagttcacattgcatgcttgtatcaaaacatcatatataccccacaaatatatacaaaaaactttaaaattttaagtattaattgctcaggaaaaaattaaaatgctggggtgctgaaatctcaagggccccattacaaaactccttaggaacctcgccctctctctgctgtaaggactggttccagaatgagagaatttaaaagacattccccccccaaaatgttcataatgtcaccccggaaacctgcgaatatgttatattacatgaccagggagaagtaaggttgcagatggcagtaaggttgctaatgggctgaccttaagataaggagatgatcctggattatctgggtggacccaatgtaatcacaagggtccttaactgtggaatagtgaggtggctgagtcagaggcagagtgatgcaatgactgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccaggactgtaagaaaataaacttgtcttgttttcagcc

SEQ ID NO: 276 - DNA, 2391 bp, Homo sapiens
gattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgttttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcgagggcctggcagtcgagaaaggggactgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgc

SEQ ID NO: 277 - DNA, 3675 bp, Homo sapiens
tatgtggcagttcctcactagggaatttggtctccagggccacttttgaccttaatccatgttggagccatcaatcaaagaattgcttgcatctaataatggtgtaatgccaatactaagccctggaacgaagataggattcatttctcatggattattgagcactctggggtaacctggccctgatctgatgacgctaagatttaaaaacccagatgcatgtgactagaactatcttttctcccatgatgcactgctttcaacactgcatgactgtaaaaacatgtgtcacgctgattatatatagagatggtctaaatcagctgcatcccatttggtacccaggcaaggatttttccatacctatctttttgctggtggtaatgatgagttttgtcacttgctataacattctctgtccgtcttttgtcttttatgtaaatacttttgtgacttcattgtaaccagcattttgtaatactcttaacagcagaggggattaaatcatgattcacttctgaacagtacaatcagcagtaggaaaacgaggagggagggagagggaaattgtccaccacttcccaatgataatgcctggctcggaccccagattcacatcatacttgaagttcataaattctgggcactgctcagcttgaggaggcaggcattgctccttcatatttcagggtgagacaaatgctctgttgaagccatgccactacaggatacgttcacctctgcttgctttcctccctaagccagagtgtagttaaacatttatatgtcccaggccaggagatcaaattaagaggaggttagctactttccctggctcttaaaaacatttgagtccaagtatggttctctggcttgagggtggccatttgttgcctcactgtttttattaggacatctggagattagaggtgttaattggaagtaacttttctatatttggtttctctccacacattatgagaccttttagacccagttggatggctgtatcctagtatgaaattcagcttctaagtaggaagaactatgatagaggaacaagattgctctttgacttggtgatagtagggcaatagggagtgtcagtagggtagtttcaggtggggaggatgacaaaccactgataacaataaaaatgggtatttctcaacactcaagccaatttcccatttgataacaagtaggttctgatctattttccccaaattaatattttccctggaagattccgacctgtctgatcaaataaaggcattcctctgagagtatacctagcccacttgtggccaaattatacttgactgttatgtactcaaaacaagctttcctgttaatctctttctcttacctctattatgaggacaagacgtggaagaattaggtcaccggggcatctgccattgcatatgtttaagtggtataaagaagccaggattcctagaatggtctgtcttttgccatttctgggacaatgagaaaatccatctggagtgtttatgcccctctgaatagccaagtcatgggcttgtttgctttcagtcactgccttcagaaaaagacaattttacaatgacttacttctaataatcactgaaacagcctcatgaggacatgcaaaactgctgtctatcttcagacctggcccattgtcaaatggcagacttgcagagcaaataagggacctggcctagttcacaaggcagtcagaagtgatccaaagttcaggctccccctcccttttatcactccaccctgcctctactcctccgcctcctattcttccggcctttccatctggaaaccatgagcctcatggattccaggcacaaattctcagatttcagatgtttgggaaatttctcagcttgggtcattcttcaagagtaagaaattgaatttgtgagaaaaaaaaacagctgagactgtttcacagaagagaaaataaataaggtgtggtgcgtatccatcctcttcccaactcagctccaaaaccacacacaatgtctaacttcaaaaagagtatttagatcccccctgggaaggaacagaatgaaaaaacaatctccactcataaaaacacttttctgccttctacagtataaacacaactggcatcagataatacaatgtaattgattttatgtgtgtaattggggaacagaagggtctctagagggtagacctaagagtaatggaatggagtgaaaagtaaaatttagactaaattgttgggaggaaactgttaacattgtgaaccacttgaccctagtgttgcatcttcacaaaaaagagcaatgtgccgtcttctgtctttggaaaatgggacaagcttgctcctgatactaggttttagaagcatacagacttggttttagtactggctttgttctttactaactctgaacaattaaatgagcagatggtctacagggcttagtacagtgcctgacacatagtaagcacttagaaatggtagcttctgactgttgtgctggagtcctgttagagattcagtagatggagccaccttcatgttgcccctcactgagctgctctgctcacctctagatgctccccatggctgtttcatagccctctgtaccacatccccatgtactttttcatatcaacggtaagtacctcaaattaccgtatgtatttacttgttcataaggttgatgtctgtaactctttgaaggttgtattagtcgtttgctcccatattactaatgatgacaaagtcgcctgacagagtagatgttcaaatttatggacttaaactgactgacatcttgataatgcccatatccagaggtactccagatattatatcttcatgcagaaaactgaaagatacctttagctacatctaccccagaatgagtgtccaaagcaggtggcaccaccaaaaggcaccttcttttcccatgaaaagagggaagagagttgagaagcctcactcccatccctgctctgccactgacaagttgtgtggcatttggcacatcatgttctctctctacatgcgcctaaaatgacgggtagggtcagagacattggtggatctctcttttctcttccacctctaacacggtaagatcttagcaaagtaaaaaggacagtgataacagaaaaattgttcctctaagagtcccaagtcatcttttttctctccgtgtgtgttagcatttgtgtgtgtctgtgggtgtgtatgcatgtgtgtggaagctatacaaggaaagctgaatccatatgtagacttcatggagactagtactgctccaaatgtgcacaagccatgtgatatggtttgcctctgtgtccccacccaaatctcatgttgaaatgtaatccccaatgctggaggtgggacctggtgggaagattggatcatgggggagttttctcatgatttaacaacatccgccctttgttgtcatgatagtgagttcttgtgagatctggttgtttaaaaatatgtgacacctccccccaccttccttctgctctggccatgtaaagtgctcactccccctttgccttccaccatgattgtaagtttcctgaagcctccctagaagctgagcagatgccagcatcatgcttgctgtgcagcctgcagaactgtgagccaattaaacctctttatgaatt

SEQ ID NO: 278 - DNA, 2257 bp, Homo sapiens
ttttcagggttcagctccctgcatgtttacaccctactgcttcctccctgcgggctccaccccttctcctgcaatcctgacccggcgcccgcccgcctgcaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggaggcggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtcccccccatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagag

SEQ ID NO: 279 - DNA, 2564 bp, Homo sapiens
ggtgcggggcggaagtgggcggctgcgggacgcgcgcggagtcgcgcggcgggcgggaccttgccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtg

SEQ ID NO: 280 - DNA, 2066 bp, Homo sapiens
gtactccttggttcatgccagtgttcctgcacccagcactgaagctgaacattgacagtgatttgcccctgccccagagtcctccctgcattcccctcgagggcccccgtctcctggccctggtgtccacttttctctcagctgctgggaacgtgttagtgtgcactgttctcctttccctcacctgctggcttcatgttagcatgcaccgttctgctcactttcttcccctcacctgccgggatcatcttagcatgcaccattctgctcactttcttcctctcacctgccaggatcatgtaagcgtgcaccgttctccacactttcttcctctcacctgccgggatcacgttagcatgcaccattctgcacacttccttcccctcatctgccagggtcatcttagcatgcaccattctgctcacttcaccttcttcttctcgcctgctgggatcatgttagtgtgcactgttctgcacactttcttcctctcccctgctgggatcatgttagtgtgcaccgttctgcacactttcttcctctcacctgctgggatcatcttagcatgcaccattctgctcactttcttcctgtcacctgctgggatcatgttggcgtgcaccattctgcacactttcttcctctcgcctgctgggatcatgttagcgtgcacagttctgcatacttgcttcccctcacctgccaggaacaggttagtgttccccattctgcacactttcttcctctcacctgccgggatcatgttagcgtacaccattctgcacactttcttcctctgtgtacgtgtgtgtggttttcctttcagaaatgggtcatactctgtggacatctttttccacttaaagtgatggcacagccattttcccagtcaagtaacatgaatgtacaagtttagcaaacttcctcctgagagatggagagatcaaggcttctgctccgtggcagccatccgtgcacatgcatcactgtgcgtgagttggtcccagtggcttgctgagacatgctctgcacaggggagatttcttataccagcagtgtgggaggcagtggggcaggtagagccacaagtggggatgagggagcagagtctagggcaggctcctggatggacaccagctacactgtctattggatgtgggacttccctcactgatgaaatgaataagagaatcttcctcatcctgctgttgttggcgttaaaacgggttaatgcatgaaagcaacaaagcccggcctgcagacagcacctggtaagtctcctcttcccagcatgttcaacaggaagccctcattccctctagaatgtaggagtcttgccagcagtggcctgtttgttctctgcctgttgccgacctgatgagaacataaaattggtgtcttctgtatagatttccttcttattgcccctactgtggctgaacataccttcccccgtgcttgaagtctgttcatatatgttctgctgtgataactgcccattcttgttctctatctaagaaggcatttagttttgaaaatattttgttggcttgtaagatatttgtacatattaagcacagcaaacctgtaacatattcactgtaaatcattattcctcatgcatcatttgccatttaactgtatttttttccttcttgatgtaacctgctatagtttacatttttaaatcagaaatgcctgcacattttaaaacgaagactcttatgctctagcctttgaggtcatgcttggaaagtcctttctcacacaaagattatttacactttcatctctttttctctgagtacgtttcagtgtttaattgaccaggaatgtatttcgaggtgtgatatgagacaaggatctgaaatgcttcgcccactgaatcatcatgcactgaccgaaatgccacctgtatgagtgctaaaatcattgtcgctggacctgtgtctgcactgtttaattttagtgttgtttctcacatcagcttctgttgttttcatggttgtggttctcatacttttaatatctgttggagcaaataaagcctcgtttctcatcttttc

SEQ ID NO: 281 - DNA, 2945 bp, Homo sapiens
gagatctgcgtcgcgctgggcacgctggccacccggtccggaatgagtcggggctccgggaggtgcccgtgggcagagcgttaggggcgcggccgtgccggacccgccctggggacccgctggagctggaggaggaactaactatggcttggcatcttcttccgagcaagcgcagctctcaggccgggcctgagcctgcagcctgtgtgccctccatcatcagggccccctctcaggacaggctacaccgagggtgggacagcggacttccagggacacttccaagtcgtgcccatgcagatacctcagtatacactgcccacagttaagaaaccacgacctgagacattgttttgaagaggtgaaaatgcctgccctccttctgacaaaaggagggggtaggatgtgaagggattgaaagtggcgccatctagacccaggaaaaagctacggggtgggcggggtaagcgggggactcttggtaaatgtggataattttgaactgggacaccattttgtttccttcctagagcattgtatgatgtggcctgaaggctctggaaagtcacagatcacacccagcaggaggttcttcatgtgtgccagcccctggctgggcctgggcagccttgcccccatcccctggccccagctcctgccaccccacctgcagacaaggctgccaaaggctagggacagggctccaagctagaggccggctttttggagatgtggctgtgggaggggaatcccaggaagttgcatagagagggagtttttgccagcctgggtcactgatggccagtccgggtcactgatgtctccccaggggcaaggggacagtgcctggctaattgtgggtttcaaaatctgtctgttgaggggatgcagaggtcatcattggggggtgaagctgatggtccacagaagctctgggcacaggttggacctctttcctgcacaaagaaccctccagggtgcccagtggttctggccagcgccggagccagtgacggttggcttgttctggccttcctccccttctcacacatgcattctcttgcacacgtgtcacacacattcctacacactcacacaaattctcacacaaattcccagaatcaatctcccacatacacatccaagtcacacactcattcttacatgcgattcacagattcacacgattcacagatgcaacagactcacaggcattcactcttacatatgacacagttgcacacttgcacacacacacacacacacacacgcactgcaatccccttgcatctccacagtgtcgaaggctggctgaacaccaaggtggctcttggtggcaggacttctcatgggagggaaagtcacatagctggaaggttactagcttagggacataatttccttattgactataatctccttatagaaattcaacaactatagcagaaaatggagaatgaggacattttatttctcaaagtcaacagttccttttctcctgcaccttcggagcaggctcctgcctgaggctgctgaggtgctctgggttctcgctgtttgttttcagcatccaggttcaggcttttctcagtgcattttcctcggctgcccttggacttgtgttgtccggggtggtggccactggcccccagtggctactgagcagggagagcagggcccctctgtggtgaggcgtgctgctcggtgtaaaacacacacgagattttccagatgcagtactcaaaagcatgtgaaactcctcagtcatcacttaaaatattgatcacaggttgaaatgattatattttagataccttaggttaagtaaaatatattattgaaatttcaccttctttttgctttctaaaaatgtagctcttaggaactttgcaattacctacatggctatttgtgtgttatcttcctgctgggcagtgtgagaccttctcacagatccttcagaaatgtcaaaggaaaagcaaaaatggtggagaaggctgagcacgtggcctcgcgggaggccggctcagagctgttctgaagttgcttttgtaacacaatctattctcaaagctccttttctttcaatggggcaggttgggggtggggggggggggatattacaccttgtattttacttctcgattcattttctttccattttaactttaattccgtctaattactgtattgtgagctcagtcagcaatcttgcatgaactctgcagtaacttctgaagactcttgctccaagtgtttgataatgaggagatgtgcaggactaaggcgactgtgtgatgtctgcacagttcgaaagcccgctttcctgttactttcaaatctcgggtcagcattttggaacttttctgctttaatttttccacacacacctctcactgcgaccacctaccatcaccacaacccaaaacaaagcaaacaaacagaaagcttgaacaagaatttacatctgggaaaacgcttctactcatcaagagtggaattcctttttattcctataattgactcacagcttcaaaaatctgtgaagtcatactttggtcacggaagttgcaagaaaccatatttgcaaacgttttattttaaagaaggtatttaaaaatatttcacatattagccacagatttctagaagtgaagttataaaaattagaaattatatttttccttttgatgatagcaagtgaaaagagattgctccaagcatgttttcaataaattcagtataactgcaacacaaaaattctgcatgcaggcttcatacacacacgttataattttatgcatttatcttgagagttgtataattaattttaaaaatgcaacagaaatgtgaagttaagtctactttgccaataatggaaatgtctcatagataattttgaatacaattaaaattttgtttttatcataaaaaaaaaaaaaaat

SEQ ID NO: 282 - DNA, 2341 bp, Homo sapiens
aattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaacaaaagtccagaatgttgacctaattttacaaaacaagctgcatatcagctgatgaatgcatgggaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatctggagagctaggaaaaataaacaaccttatgtcaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcgctttcctttgtaatttcagggcttaagcactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatctacagccttcagtgatctataatagcatttccttctgtctcctctcagtctctcttccgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagt

SEQ ID NO: 283 - DNA, 2140 bp, Homo sapiens
tctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaactacactgtggtccctgaagggacgcggagaagccctcagccccgctccccgtcttagcggccctcccctcgcccccacagaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggagggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtatag

SEQ ID NO: 284 - DNA, 2731 bp, Homo sapiens
gtactctgcgctgggcgcgcggaggcctaggcgggaagctcgagcggcggcgccatggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcctccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacggtaacagggccctggctgcgggttggggtggggctgtcctgatgcacgcagacagctggaagggtcttggttttctgaaactccagcttcatgtgaccctgggtccctgctctgtgtcctccctgtggtggggctccctgcactctggtgttcatgccgcccccgtgccctgcacaaaaaccaccaccagcagctcacatttcacgtctcggcctttcggccatcggagtcggtttaagccagcgtttacacacctcgcctcgttctctctgctggtgatgcggttgtaagattttcacgtggcagagcccctgcagctgacccacgcttgggcatcaatggcacctccacacagccgaagcacccggcatcttggtgggggcacctttttaaacattttttttttgagagagagccttgttctgtcacctaggctggaatgcagtggtgcaatcatagctcactgcagccttgaccccctccctgacctccccgccagctggactccagccatcctcctgcctcagcttcccagatagctgggccacaggcgtgtgccaccacacctggctaactttttttttttttttttttgagatggcatcttgctctgtcgcccaggatggagtgcagtggcgcgatcttagctcactgcaagctccgcctcccaggttcacaccattctcctgcctcagcctccccagtagctgggactacaggcgcctgccaacatgcctggctaatttttttttttgtatttttagtagagataggctttcaccttgttagccaggatggtctcacgttttgtttttttaactttttgtagagatagggtttcattacattgctcaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgc

SEQ ID NO: 285 - DNA, 2565 bp, Homo sapiens
ctcctggcctcaggcgaaccttacgctttggcctcccaaagtgctgggattataggtgcatgccgctgcacctggcacttctgagcagtgcttggaagccgcctcctgatgggggctgagggtcagagtggccagctgaatgctgggccatcagggtgaggggcgtcttctcctcgtccattgcctgttctcccagggcaggtggaaggggaaggccctgcattggggtggcgtgaaacaagatgagatggtaagatctgctttcactttaaaggaacatttctggttgttgcttggaaagaagtgtcaggggcaagaatgctgcaggagggctggcctggaggacagggtgggactgcgggctggctgcacgggggcaggagcctgcgcttgcgtcagaggttcctgagagactcggtctctggggcagaggcctgagcaaggggacctcgctggggtgtctctgtcttagccacgctcggtgtttctgggtcctgtgacccacgtgtgagcagcctgtggtgctggtggcacagggaaggaaaccgaggcagggagcctgtgggggctgcttggcaggggacaggcagctcctgtgcccactgctgtcccacacctgcatggaaacagaaaccccgccacggagccccctcccatctccacagggcctccagagcgccatgtgcacgacttcatgggcggggtggggtggggtcaggagcctgctgtgggctggccaggccctggccctccctgtcccaccctgcgctgcctccatgcacctctcagggctgtcatggcttttcctgtggcttctgacaggtagagtcagcgatgacggcttcatagccattaagctcacagcactggggagaccccagtttctggtaagtgctagaaccttccacctgcagagtctggtgctgtgcgagatctcagggcagctgtgggcatccaccaaaaacacagatgcccatgccttagaggcctgagctggccacaggggctgtgtgggggactggggtgggcaggggcgtgtgcagatggcattcaggcctgcgttgcagctgcagttctcagaggtgctggccaagtggaggtgcttctttcaccaaatggctgtggagcaagggcaggcgggcctggctgccatggacaacaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 286 - DNA, 2264 bp, Homo sapiens
atgcttacaaagcgtggctagtatcttattacagaaaacagagcccacatcatgcatccttcttctcacatttcataaacaaggccaagggaaactgctgtggggcaacctgttgctttggtgttggtccccaagatgcagccctcacaatctgcccccaaacgtgtcagaacatgaaccccctcctccccctctggaagaggcaacctcagatccaacagcagagacacgcagcagaacaaaatctgggcattggtccctgtgtaggatggcttcccgttattttttttttaagcaaagtaaatgaacatcaaatttccatagtcagctgctgtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctaattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccat

SEQ ID NO: 287 - DNA, 2197 bp, Homo sapiens
gttttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaagtgagggaagctggtggtgggaggggatcaggtgggcttctagaaaggatgtggtccccagaactgtgggcccctcatctgtttgtcagatccgggaggagattgagcattttggaatcaagatctatcaattcccagactgtgactctgatgaggatgaggacttcaaattgcaggaccaagccctaaaggtggggccactctagggcatcccattcctatcttatttcttccgggtagaaaaagggagtagaattctatattcaggttatcagggtgggaaaggaccctggcttcctagaatgaaccagagaagatgacgatacaggtggaaagaaagaggtgagaacagagggtgctgacaggcacccctaacctcttccaggaaagcatcccatttgcagtaattggcagcaacactgtagtagaggccagagggcgacgagttcggggtcgactctacccctggggcatcgtggaaggtaaagcactgagcctgtgaccagggtatctccttgccctcagtggctctcccctacctatgcctctggctgacccctagccttgctatgcagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 288 - DNA, 2005 bp, Homo sapiens
gtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgctcctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctc

SEQ ID NO: 289 - DNA, 1840 bp, Homo sapiens
ttggcttttggaaagaagagcttttcttctcttagaaactgatttttttttaagcatcagctggactgattgtttcttattctgaagtcaatgtattatagtccattccagtcatgattcattttggtgttgaaattgtccaaaatttgcccagtagaatccccttcaaggtagctcctgtctttttaaaatattttgtttggaaatatttcaaacttataaaaaattgcaaggataataatacaaagggccactcatatatcctttttccagattacctactgttaacactttatgctatttgcatcatcatttgcatgctctttctatacatacacagtatttattttttttccgaaccatttaagactaagttgtatacatcaccaccctttacccttaagtattacagtgtatatttcctaatagggatatattttgttacataaccaaagtatattgttaacttgagtaaatttaacattgatttagtatttatgtctaatctgccctccatattctagttttgttagttgatctaatgttctttttagtaattcctttctagaacagaatccagtctaggattgggtattggctttaggtaccaagtctttctaaacttttctgggatatttacacagctcgtattttttatgacattgacatttttgaagaaaagtctgcttcccctgccctgcccttcaaaacatgcttctcacttggggcagtttctggtgtgtcctgctggttggatgcagggtatgcatttcaggctagggacagtaagtgatgtgcttttctccgggcctcatatctggaggcactgatgtctatcagccctcagtggtaattctgattttgatttgataagcaaaaagaaattgtatccccctagatttagtgtccatccattgatggtgcttgctagaaccagtctttagtatgatggttataagaactgtcttctaattccagcattccttctgcatttaagcaattggcagtcagcattctgcagcatcctttgccccatttacttatcattggtatgaattcattaatttctgtttttctccagtggctttggttcatttctgtccttactttgttgctcaaatggtctgatttggcctagtgactagcttttgtatcttttgacatgtcatttccttactttttttatttacttatttacttttgagacctagtgttgctctgtcacccaggttggagtgcagtggcgcaacctcagctcactgcaaccttcacctcccgggttcatgcgattctcctgtctcagcctcccgggtagctgggattacaggcatatgccaccatgtccagctaatttttgtgttttcagtagagatggggtttcaccatgttggccaggctggtctcgaactcctgacctcgggtgatccacctgcctcggcctcccaaagtgctggaattataggcgtgagccaccgtgcccagccttatgtcatcatttcttgagcactcctttctgctttctagcacaacacatgtatctgtacttctatgtctctgtctataaatatatgtaaaccttgaggttacactgatacatccagttttaaaatttcatggttcattttagttttacttatactggctttttggatgatgagaaacctggtggctcccatgatccttaatatagtgacttgatcaaagccctatgtgtgactaattcccattactgttgctgcctcctcttctggagggagccctttttcttgggctctctcaccctcctatggatgcttgcttgctccataggactggattgttcagaaagggaaagaagggt

SEQ ID NO: 290 - DNA, 2183 bp, Homo sapiens
cttttatatgctctgctcgttttatttcaagctttttgtcatttataattttatattctataacatctgcggttttttgtttttgttcttctgtttttggggggttttttttgagacggagtctggcgctgtcaccaggctggagtgcagtgatgcgatctcggctcactgcaacctccgcctcccaggttcaagcgattctcctgcctcagcctcccaagtagctgggactacaggcatgcgccaccacgcccagctaatttttgtatttttagtagagaccaggtttcaccgtgttggccaggatggtcttgatctcttgacctcctgatccgcccgcctcagcctcccaaagtgttgggattacaggcatgagccaccacacccagccacatgagtgtatttttgacagcaatgtagtcaccaataaacgagtaacttcagttaaagtactgtagattataatacacagccctgtaatctaccctggagttcaacaaacggtattgaaaacagactgtgttccagatgcaataggaagagaataaataagataaacaatacataaatcctgcccagaagacgtttgcaattttttaagaggaaaaacatgaagacaaattgttttaagatgtttgctattttcaatagttgaaaaataaacaggagagaagggattatttaactgtgggtatgtagggctgagaaaggcacgcttgacaaaggaaacctgggcagtgttaccagaaagcgttgccaatcatgagtccatatagtgaagtgaaagcaagtttattaaagaagtaaagaaacaaaagaatggctactccataggcagagcagtggcttgggctgctggactgagtatatagtttttttgtgtgttgtttgtttgttttgacacggagtcttgctctgtcgcccaggctggagtgcagtggcgccatctcggctcactgcaagctccgcctcccgggttcacgccattctcctgcctcagcctcccgagtagctggaaatttattgtatttttagtagagacagggtttcaccgtgttagccaggatggtctcaatctactgacctggtgatcctcctggctcggcctcccaaagtgctgggattacaggcgtgagccaccgcgcccagccagttatttcttaattatatgttaaacaaggggtggattattcatgagttttcaaggaagggggcaggcaatttttggaacttagggttctaccctcttttagactgtatgacttctggatgttgccatggcatttgtaaactgtcatggtgctggtgggagtgtcttttagcatgctaatgcattataattcacgtataatgagaagtgaggatgaccagaggtcacttttgtcttcatcttggttttggtgggtttggcctgtcttctttacgacatcctgtttatcagcagggtctttgtgacctgtatcttgcgtggacctccaatcttctgtgactaagaatgcctaacctcctgggaatgcagctcagtaggtctcagcctcgttttacccagcacctgttcaagttggagtcactctggttcaaacgcctctgacaacaggactattggagtactgataggagtttatttgccttaatcacctggccaccctatccctttcttatttcctccctactcctccgtcctgggagactgaattcaaatagacaatggccagagaatatatacaaatagaacactaacctacaaccttcaacaaccagtccaggaaggcaacctactatgtccagtaaccagtccaagaaatcagattactatatttagcaaccagtccaggaagccaagcaataacccttgtagcaatctaccccaaatggccaggacgtgattaataacttacagcttctgtaagttttgtcagggcttccaactcaaggccagctagagagagccaaatatctacccacccctaaataattacataggatgccctgcttttagttagcccacctgcagcttctccatgccaacagccttgaattggcatacctgaagctttcccttttttccactctaaagctttctcactcctctgcctgccgttgagtctctgacaaatgcaagtgatgatggctgactcccttgctattgtaagctccaaataaatttggctttgcttgttctc

SEQ ID NO: 291 - DNA, 2250 bp, Homo sapiens
tcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaaaataatatgtcatacaacactatgtgttgtgcctggagacacacaatgtctcctgtagattaaaatatgcacttttcctaggcagagctatccaagtcatttttccatgtatatttgtacatacgcagtgtgtgaccaaatataagatcagttctttttctactgaaaatttacgaaaaaaaaaaaattgctgtctgcatagtcgcatcttttaagctatttacaaaagagaagaggtggtggtattgggggaaagtgacttcagctattctcaaagagttagtcttcctttgattcagaatttgtcacccgccattttcatagatttaagccaaaagataaatgtgtgaaaatgtaccaatggctgcgaagcttcaggaagtagaggatccagtgatgcatttttttttcctaagggaaagctggctctttaattcagatgctgaattggtgccatgaaaacagaaaatgctattttcttattatttaaaagaacgtcttatctcataaaattgacattgttccaaagttcttgtggtgattttgcactattgttttctcgtatggaccatggtgtcacttgtagcatgtcaatcacacattggaaagtcaagtccttttacttccatgttgtatgtcaacagagagaaatgtcatgtacataatgtatattgttgtaaatactggtttcacactaagtaattctattttgtaaactgaatatggctatttaatttattgtgaaaattaaatttattgtggtatttaaaaatggaatggattaaaattactctatgtgcaattttttttttttttactcattttgttttacgtgccccctgctggcttccaaaatggaagctgtttacgtgcatatgagagcacttggaaagatgtgcttccctgctggatttctgtacccctgtgaaaatgtatttatgaagtgaggttgagtatattaaaaaagaaaaacctcaaccatctggaaatcaagtataatagccacctcaaagaaccctagtgctgctctgctacaactttgtaacaattaatttactcgcagttgctgctgctcaggaagagagacaaggaatattttaacagaatcaaggcatagaagaatcaccattttatttgaacctctaatcagagtcagaccagtagagaaattaaataagattagaaaactctgtactgaaagctgctgatgcttcaaaaatgaaaacaagatctcacaactctccctgttagttgaaaatatatcaatttgctctgaaaggattcagctgcctagtgttgccattactaacataaacatatggctcatatttccatccagagaaattaatgctaaattggtgcctcgctaacatcagatacactgtattatgcttaaatatattcagtaaaatgtggaaaggggtattaacaacgacaacaaaaagatggattttttttttctcacaatcacagttgctaatccagtgggagatgtttgagagagttttgttcaacatcacagtgagagtgcctagggaaatcagaaaattacaatggattcccctttgattgtaataagtgttgattttctccatgagttgtttatcctgtctagtgatttgatggtgaacttttctaaataaatagccctttcccctcc

SEQ ID NO: 292 - DNA, 2845 bp, Homo sapiens
ttgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcagaccaagaagtcaggggatgaatgggctccctgaacttcctctggcaccaagacctgcgctctttcagcaataaaagtggagcacattaatttggtgtgaatgtccccatggccgtatccacattgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacatatccacctttattcttctccatcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctgagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaacgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtattggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaggaaagttgattctgcttggagaatttctcaagctttacattttttttttcactgaagaaaataaacaaactctaagaggtgtgcatatataacatttctttagatctttacctaaatggaattttaatatattattggttgatgtaaattttgtttctgtggagttttgtttgttgttttgctttttgtagactgccatgtgcaagtaaaattcctgcttctgccatgttaaaattttaatatattttaaatgataataaacagagaaaacaaaattt

SEQ ID NO: 293 - DNA, 4022 bp, Homo sapiens
aaggcgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcagaaacaagctcagaggtgtgcagcgaaacctggctgggagtctagttcgattgagtgctctggtgaaaagtaaacagaaagcttacttcatcctgtctcttggtagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgatcccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctttgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcatcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcgtagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcgttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcacaggagctgagggaacaaaagacttgctcgctgtggggtgatggtgacaggcctattgacctgcaatgaagccctctggtgtc

SEQ ID NO: 294 - DNA, 2304 bp, Homo sapiens
aatcatgcttacgcatataggttaaccacagttatgtaagcaggttctgagaaaaggtgagaaagagaatggagagttttgctacaacagaggcaggattctgaatttatttccagctgcccatcttgtccctcctggagacctaacccctccagcacctacacacacagcctctttagaagcaactatcctgccactggctcagaaaggctgagtcctaagaattctaaaatcttgctcctaagaaatctcaagcttcttttgtgaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggggtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgtaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgtttt

SEQ ID NO: 295 - DNA, 2079 bp, Homo sapiens
gagtgaccggtgagcgggccggggtgggatgcgctgtggcggctgaggcgccctcgcccgactccggcgctgtcctaggcgaggggtggtgaggcccggaggtggactgttccttgctcgggggctcgcagcgaatctgccggcgacagagctccagtccacatgcgcccccgtctgacagcacctcttctgtgccctgccagggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggtccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatg

SEQ ID NO: 296 - DNA, 2321 bp, Homo sapiens
aggatgcaggggagagagcgccgaggaataccgaggttcgttggcatgctcctgctgccactaacccttcttctttcccccagtgctctactgtgcggagatcaaggacattggccacctgacccgttgcacgttgtaaccgaggaactcggaagctacagccgaaggaaggtgggagctgcagcctcgcgggggctgatgtcaagactactctctctcagatcccaggattggcatgtgatgagagagatgagccgaaggcaggagggaacgccctgggaggtgttgatgctgagttggggaggctcctagacgaactcgcccccatctactgactgtgccagtcttacattttcaggatggagtggccaagggatgatataaacaaagcctacgttaccgtgggaagaagacagactgttttcttagctgggacgttggcttttgtccagggtggctctggtgtgtgggagcaacaggtcccattttagcaattctttgtcaatggtttgaatttttttttttttttaagatggaacgggagagaagaggctaattttcgcgtcatgttaatctcacttctctggcatgtaagggtgctggtatgcctgctgtctccccactcccagttctgtgttccagaaattgagatggctccctgcctgtgactatgattaggagccttgcttcatttcagaatctcccttcaacctgctagggcaggtatcagaaattccaaagggcatttatgtgaggcacctaattagagcctatcaaagtaggaagggagagccatttgaaaggcatcatatttcaaacttttgctattatctgtgttatctttacagtcacgggaacacactagcgctactgaaaagatacttatacaattttaagtgtctttaaaatttgtgtcccataatgggacatcacctgttgtatatatgccatgcattctattttagaatcctgtatcttatgaccataaagtcatagtcaaggaccagcagtgttggtgtactgtcaacggaagtgcacagtctcactctaggatcccactccagacttcctgaatcagactctggcagggttttttgtttttttgtttttgttttgagccagagtctcactgtgtcgcccaggctggagtgcagtggcgtgatctcggctcactgcagcctccgcctcccaggttcaagcgattctcctgcctcatcctccggagtagctgggattacaggcgcctgccaccacacctggctaatttttgtatttttagtagagatggggtttcgccatgtttgtcaggctggtctcaaaactcctgacctcaggtgatggcgcccaccttggcctcccaaagtgctgggattataggagtgagccaccgcgccgggccagactctggcattttaacaatcccaggtgatgtgtgtgcatgtgaaaatttaagtaccattggtctagatcctacactctttaggatatcaccatctgtaggtagaatatttaaagcataataggtatgactgatagattattttatccaaagttcttttttttttttttgagatggagtcttgctctgttgcccagactggagtgcagtggcgtgatctcggctcactgcaagctctgcctcctgggttcacgccattctcctgcctcagcctcccaagtagctggggctacaggcacccaccaccacgcctggctaatttttttgtatttttagtagagatggggtttcaccgtgttagccaggatggtctcgatctcctgacctcatgatccgcctgcctcggcctcccaaagtgctaggattacaggcgtgagccaccacgcccggccccaaagttctaaagtaacattctattgctaaagaaatcctaacctactatgtaacatttttctcttagttaaaaatgtgaacttattattaacctcaattttttagaggcctccaatctttttaaaatataaatatttttgattgacaaatcataattatacacttatgggggtataaacctcaatttttgtaaccctattttggcattttcctgtccttacatctcagcttaaatgctccctcttttgggaggcctttttctgccttcaacatagtagagccttttcccccacccctctgtaacataatgccctgttttatttttactgcttttattttcatgctttgtgggtgtccccactggagtgtaagccctatgggagcaagggctgacctgtgactgttttatctccagggccaacagcagtgttactgtatagtatgtactcaataaatatttgttggcttt

SEQ ID NO: 297 - DNA, 3124 bp, Homo sapiens
gggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcattgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggcgctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcactcaccaccatgcagatccaggtcgcggggctgctgcagtttgccgtgcccctcttctccactgcagaggaagacctgcttgcaatccagctcctgctgaactcctcagagtccagccttcaccagctgactgccatggtggactgccgagggctgcacaaggattatctggacgctcttgctggcatctgctacgacggcctccagggcttgctgtaccttggcctcttctccttcctggccgccctcgccttctccaccatgatctgtgcggggccaagggcctggaagcacttcaccaccagaaacagagaatacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctagcagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttacgctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcataccgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtact

SEQ ID NO: 298 - DNA, 2498 bp, Homo sapiens
acaactatggcttgtctgagtcctgagccagcagagctcaggccacagcacctgcacccgttttctgctgctgcacacaagggctctgtgcattccgcatccaggtgtgcccctcctcttctggaggattctttttcaggctgtcccagagactttgcagcacagcatccttgctctatttcttcctgcaacatctctgctgaagctctattgcttttggcaactcttccgtctattttgtggtttaggtgtctcctacttttactaaaaatggaatttgtgtttttatcgctcaagtcctttttgcttttggattacttccagaaaatgaagggagggttactaactttatgccatcttcaaaccagaagatcttagattagtaagatcatgttggccatggcatggagaatgggctggaggtggagagactggaggttggaagtccagttaggagattgctcctgcgctggggagttggtgttaggacagaagatccaagacgcgtttcagagagcccctcttcttgggcctgcgattcctcacctggaagggagaagagtggacttcctgcctagagaacaccttggtaaactctttgtggttcctgtcatgagaaggtgtgcagcttagggaaaaagcctgtgagctctggaatcagatggaactggatatgaatttccatttagtgcttgttggattaaatgtgatgctacttctcccagccgaaagaataaaactggtaagaggaagggaaatgcagcctcagtaaggaggcctccattctggaagggcttcccaggcccagagaagggagaaagtaatttggaaccacccaagtattggtgatgccaggcctcaccctaccctggggatatttgaatctcaaaaagggagcatgggaatctgacaaagcacttgcatgtataaagaactcctccaaatcaacaaggcaaaaacctcattagatacataggcaaaaacctcagaagagccacatcacaaaggagcacctccaaatggccaagaagcatatgaaaatatgttcaatctcattagctaccagggaattcaaattagaactacaccaggatggctgaaagtgcaaagactgacaatatcaagggctggtggggatgcagaacaactggaactctcctacgcactgcggaaggggtaaattaataccgcccctttggaagaacagtttagaagcatcactaaagctgaatatattcatgcctactccggaaatcctgagcccaggtatatatctaacagaagtttgtttataaaggcaccaaaagtcaattacacaagatacaagaatgttcatagtagagccgtttgtattagtcataaactggaaaccacccaaatgcccatcagtgtggctccctttgaagaactgccttggggttcatgttgcagcatcaaacagggatggaagatgcatcttgctttagcagcaggagcctggaaagcagctgaagccctggagggtgcctggcacacagaatcttgtgctgagcccggagcacaatgggagtgggctggcggggtgggttcacagctggactgggagcagcagacatacaggccgtaggcacagacatataaagacagtcatgcagattgcaggatgcctgagagcacagactctcacatgcacaaatacgtgcatgatcgccagtgtgcatccagacagccccacatgcatgcacacgcatgcacacatgtgatgtgtacatagatggacacatgtctatgcccacaaacactgcagagacacagaagtgtctggcaaggaacactattttgtcctcaattttctgccagtgagagtctactgactccatctctgaaatgtctctacttattgtccctcttctccacctgcaccacatccctagtccctgaaactcccaccgagacccctgggcaatagcaaagtctgcacaggattcctgctccgcctctaccccacccttaagcccatcctacatgcaagagcaggagttatctgggtatcaagcaaatctgaccacatcacctccccactgcttaaaaccctttcctacaggatgaagttgaaatcacttgacatcccatataaggcccttgattgtctggcatcagccatagtctggcctcaggccctggcatggagtcccctggactcagtgctctggctgagggcctccaggatgaagataccctgtgcaaagcctcacacttttgctgttgctgggctcactgtgtgaaattccctcctccctccttccaccttccctatgctgaactgccactcctccatcctccatggccagctaagccaacacctccccacttcctcctgacaacccaggcacagccactgacctgtcccatggctgtcacagccctttcttgggctctcaatggtatcattgtcacctgtgtgctcatgagcctctgccactcaactccaagcacatcaaataaagagctcaaaacat

SEQ ID NO: 299 - DNA, 3624 bp, Homo sapiens
gaaaaaccaacatatttcatgaaattagatgcaggtgttaacatgtatcaccacttctctgatttcatcaatctttatattactcagcacgttaataactcattcagtactgacgtgtacatcgtgatgtgggacaccagttcttacggatatggtgacctattctccgacacatggaatgcatttactgattatgacgttatacatttgaaaacttatgattccaaaagggtactggaaattttcctgaaatgtctgtgaatatttcttgagtgcagatgactcactcataaaataaacatttattatgagttcctattagccattaccactgatttctgaatttctgaatttcttttataattagaatcctcagtgttgttaatcatgcagcctttgaaaagttttttctataatctttccaaaaatatgaattctgttctctttgaatgaaatagtgtgctattcaagcaatgcaaaatggagattaattaaaatctatttctcaaaattatacgtgctatttttggtgtgaagggtgcaaattacatcttcttttaatgtatctttgttcttaggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatatttt

SEQ ID NO: 300 - DNA, 2091 bp, Homo sapiens
tatttgttttatgcagcctgggtcttgctatgttgcccaggctggtcttgaactcctggcctcaagcgatccgctcgcctctgcctcccaaagtgctgggactataggcatgagccaccatacccagccaataaaggggtttcaatatatttctttttattttttattttttgagatagagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagtagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttgg

SEQ ID NO: 301 - DNA, 3685 bp, Homo sapiens
ttttgcagctttcagagcccagcagcaacgcttgccagttttcagtttattcggctccctctacttgttgtgctgcaatggaagtaggatgttgagctttgtcagtagagggcgctggagggaccttgcagcgggagaggctgcttttcccagttctggtgttgctttgcccctgcagtgcagtcccccagtaatgccaaggagagcaggaagtcacctcgcaatcctggcctgggccacccaggggacttcaccaccaccattactacttttgcccccttgtgaaaaatcagtttgttgtagttgtccacgtccgtttctgtactttttattctgttctgttggtctgtgtgtctatctcttcttcagtatgacacactgtcttgactactgtagcattatagtaaatcttaaatcaggtagtgtgatttccccaactctgttctttttcagattcattttggtgattccagttcctttgcctttccatataaatcttagaaccggcttatttatgtatctataagaaatcctactgggatttgtgatttgggattgcagtaaatctatggataatttggagagaactgggcatcatttctgtgttgagtattccattccatgtacatgatgtgtctctccatttatttaggttgtctttgagttctttcttcagcattttgtagttctcagtatacagatcccgtatgttttatttgatttgtacctaatatttaattattttttgcacccattgttgtaaatcatttaaacatttttcatttccagttcaaattgctagcatatagaaattcagttggttttgtgtgaatttgtgtcctgtgaccctgctaaactcacttttttagtctaggagtttttgctttttgttgaagtctatgaaattttctatgtagacaaagatgtctatgattggagacagtttgacctcttccttgtgaatcaggatgcctcctaattctttttcttgccttgttgtgctgactctgaattcacttctggtacgatatttaataggagtggagacggcggacagctttgccttgttccctgcattcgttctttcaccattctgtacagtgttagctgcagggttttttatgtagatgttctttatcaagttgaggaagttcccctctattgctctttctctgagagttttatcatgaatttgcgttgaattttgtcagatgtttcttgagtcctgccttgaggttaggccaggcgatactgcaggaaaagcaggaaacacgccaccagtttggtggtgctttgaattctggtcttctccaatctgcacgtcgctgtttttatgtaagagccttcaaatagctagtccatgtattctctcagtttaatagcaggattttgtgggataaacagggtggagtaaatgaaccagagccttcttttagatacaaatgttgatactcaactatgtggttgctgtaagtaatttgttctttttagtactaagtaatattctattgtgtaaatatgatacaatttgtttatccattcatgtgttgatagacttttgtgtatttccagttatagactcataaataaaggtactatggcttgattacttgtgaagttgaactttttcctttttgtggacactttcctctgaattgcccttacccatttttaaagtgaactttcttactgatctctataagaagttcacttttttgagtatcaatgttttgtttatgatacacatcacaagtattttctctagtctgtttgggtgactggtggtgccattagctaaaatagggcctagaggaagagcaacaatgcaggaggagactctagcaaggtgaagacttttagtttcagatattttgagattgccaaaaatttggtagagagaagtgatattgatagggcattgattgattggctacagtcattctcttcattcctaggatgatattaatccatcatcaaaatctacatgcttgaatcagatttacactgagttttagtgtttgtgcctgctgtttttatcaagggaaataggtatatgctgtaggtgtctttggatgtggttctcttaatatccgtttatatgaacttgctcatgagaaatctctgtggggccagatgctagatttcttcctgttaagcaacagtaataactgcctgaatgctttgctctgttcacattgtcaggaaactgacactcatgggcacattgtcagagtcattctctggaaacatttgtattggctgtaaggtccatctcttcaccctacatcttgaccccccaccttgattttcatcttatgtaactctttgtaaaagggttgtaagagtataaataatttaaaagaattgccagtagttatttctagtgccaggcatatggcttcgcatataggggggatgctgagtagatgtcatcatgatacaaagaatcaaatggcagatgtctccaaaaatggaaagtcagagggtttcgagagtctacttcaggatttatcctgactaaaagaaataacaaatctgtttctcatttcttgttgtcattattgttgatactgtagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccacttctactatttttttttttaatctagttagtatgaaatacaacatttaaaccggaattttaaagaagtagctttccagggattcagaattaagaaagatagtgataggacatgagaaataaatttccatcaagtgt

SEQ ID NO: 302 - DNA, 2375 bp, Homo sapiens
gctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagaatgggctgcaatttgtgcacttttcagaaaagagaggaacactacaaactgctgtatgaagtttcccaggtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcatacgtacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaagaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtccc

SEQ ID NO: 303 - DNA, 2535 bp, Homo sapiens
cacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctccgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 304 - DNA, 2052 bp, Homo sapiens
gtgcggggatggggtccgcccgcggcgttgggcgcgctcgccagcccaggggtcgccatgaccgagcggcccaggcccgagcgaagcccgcgcgcggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctggcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaagttctggtatctctggactcggtcggaccccaggactggagtttcggtgaggaggaagatgggaagagtccaaggtcccagaaagaaccatcgcaggcgtctgagctgattctggatgcagtggcagcagccccagcactccccgaggaaagtgagtggctggagactacccagctccagcagagtctgcacaccagggcggaggccgaagcgccccgcgcccctggcttgctggggtcccgggcccgcttgcctctgaagccgagtatctgggacgagcctgaggaccttctcgcagggccctcctcagacctgcgggcagaagggactgtgatctcgagccccaagggtccaagtgctcagagaatcagtccccgaaggagaaacaggaacactgaccagagcggccgccaccagccatccctcaagcacaccaaaggtggtacccaagaggctgttgcaggcatctcggtagtgccgcgtgggccccgaggtgggcggcccttccagtgtgccgactgtgggatggtcttcacctgggtcacccacttcatcgagcaccagaagacccatcgcgaggaagggccctttccgtgccccgagtgtggcaaggtcttcctgcacaactccgtcctcactgagcatggcaagatccacctgctggagccaccgaggaagaaagccccccggagcaagggcccccgggagtccgtcccacccagggatggagcccagggcccagtggcccctcgcagccccaaaagacccttccagtgtagcgtctgcgggaaggccttcccctggatggtccacctcattgaccaccagaagctccacacggcccacggccacatgtgaatggccagccttgggcctcggccacccggccctgagtccctggggggagctgatgggccccagaagatgggggacatcccccagccccaccaacccctggccaccttgggactcctcttgaaggacgagctgtttctcggaagaccctggacacctgctccgaagccaagcacgggatggggcttcccagggtctcagctgagaagcagcagttccacagcacagcctggtcagtcctgcgcactatagttttgcaagtggcttgaagaggagtttcattcgcgtcccatctttcagaagccttgtccaggtctccctgttagcacctgactcagcggcagcttctgccgctgggttttcatttcactgtggatatccctgaggccatgagggtgggagccggcctgggcagctccaactccagagaagggtacagctgaccccggctgccctcctgccagcttagcccccttggaacctaacagataaacagggttttgtttttttccttttttgggtaaagtacatgcaacataaaatttaccatttcagtcattaaaaatgaacagttcagtggc

SEQ ID NO: 305 - DNA, 2105 bp, Homo sapiens
gttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcagcttgtccgggaagagaagtttattgaacagccagaacagattgcagagttaacgctcaacagcttcatccagaacacagaaatctgtcggagttgaaatgtgaaggaaacgcaggctaggaagacacaccagtcttgacggaggatgaataaatgaaagaaggtcagccaggaggaatgtttctgcttcatctctgctcatatacagtgtagcggccatggaggggtaccactcagatcactcttcaagtgagtcctctgtggcatgcatgactgacaaatgctccagctgtcacaccttcaggcccatggtaactgaatatagcaggggcactagagctgggccgttcctgctgcacatgagatggtgtcatggatgactattgcatgaggactccctgttgacctggccaaaactttcttagaactgcactgtagtcacagctcttcctacttcctcctccttctttcccactctcctttctcgcacttcagactcacatcatggtctgaaggctctctctgcctcctcctgatcctctcctttgtcatgcaccagagcttctccaatacatctcatgcacagctaatcccatcttggtgtctacttcctgaagaatgctaatgcaaagacacagtgactctgtttttcagcccacacgtctctcacctgggaaacagatcaattctatgatatcatcatgcaatggaatactatagggcagtcaaaatgaacgaattagagatataggcatcaacatacatacatctcaaaaagataatgttgagcaaaaacaaaaatgttgcagagtgatacatacagtatgtaacatttatacaaagttttaaaacttgtgaaacaatgtcatatataatttgtagatgagtacatatgtgacaaaagcataaaaacacactaagggctgggtgcggtggctcacgcctgtaatcccagcactttgggaggccaaggtgggtggatcatgaggtcaagagattgagaccatcctggccaacatggtgaaatcccgtctctactaaaaatacaaaaatcagctgaatgtggtggcacatgcctgcagtaccagctacttgggaggctaaggcagaagaatcacttgaacccgggaggcggaggtttcagtgagctgagatcgcgccattgcactccaccctgagcacagagagagactccatctcaaaacaaacaaacaaac

SEQ ID NO: 306 - DNA, 2912 bp, Homo sapiens
gtaaaagcacagtgtcagtaggatttggtttggggctggaagaaagctccatcaagatggagttaagaccaggcacagtggcttatgcctttaatcccagcacattgggagaacagggtggacagatcatctgagctcaggagctcgagaccagcctggccaacgtggtgaaaccctgtctctataaaacatacaaaaatttccagcctggcaaacatggcgaaaccccgtctctactaaaaatacaaaaaagttaggcgggtgccgtggctcatgcctataatcccagtttcttgggaggctgaggtgggagatttgcttgaacctgggaggcggaggttgcagcgagccaagattgtgccactgcactctagcctgggcaacagagcaagactctgtctgaaaaaaaaaaaaagattgagttaaagttaggctttaattaggcgtaggattttcttaatgttggttgcttttaagttaagatttgtagttgtccaagaaataagatttgggtttggtttagagttgggttagcgattaggttcatgtaaaagctagattagagagacactggactgcatttagggctagatgtatcatttgttcaatgggcattaggattaggagctgcttgtaataggcaagttttgctcactttggtcagggattctgatagagtgggatcccatggagactggcctagtttgattgaaatcagcccccagctccattccaggccacaaggctatgaggccggtatgagatggatggacaggcctctttgtctgcccatcaccaggccttggtgctagtgatgacaccgtcactcagccatggtgtccgggcatggagaatgcctcagtcagtacccagcccattggaacaaaagaggcttcccacctggcctcctgtgcccccatttaagggctccagccataggagttttgatgggattactcacgtggacctcctccttccattctcttgggaggctcaagaagggagtaaggggattagcggagccctcctgtcaggatacttgaggtgtccggggccccagaattctcagtgtcctggggtggaggcaggaggccatctgcatatgaaagaacctcagtgtctcaggggtggaggctaatgggtttatttttcctcagagggacaatccttcagctggcagttgctgtctcagctccctccccaccaagaaaggatgtgggtgttggctcagaactgccccctctttgctttctttcctctcctttcccccaggtgcagctgtatttctgtgctccactttctcctgggcctgggcctggcgcatgctgccagccacctgctcagtcctcaaaccccagctcacatattccaaacctttagctccaaatcagtagatatctggggctgcctagacctggctgagggctttcagcacctggccccttgtcctaagtggagtttcacagacctgggcacgtgggctggggcaggggcagagagagtctgtgtctccctactcttaaagagctccacggggcaagctcagtgcccactctcagaagcagagccggcaccttctcccgtctctcctcaggcttgcctcctgcacagtgagctttttcttctctcctgtcctagcgaagggaaagaacagcagctcctcagggtggattcccctgggcttgcagcaggcatctggaatgggcataagctgagggtgtgggcccgagtctgggaaggcccttgtgctgctgtgggagaggagctccccacgcacagcccctcacctgtcaccgctctcttccccaggtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcccggtcagctggtggtgctgggaatggggtgccccagccttggtgaggacagtgttgggaggcccaggggcccagtaaagtgcatttgacattg

SEQ ID NO: 307 - DNA, 2082 bp, Homo sapiens
aaaatgcccagaccagcatccgaaagctggtctcctatacaaagcagaatccctgcctacaaagcagtttcccacctccgactcctccccacggcgaacagcccttctggatccaaccaacccaccaaccccaatagggcccagcacccagagggtccacaatccagagaaggagctacaagccctgtacttgcaagcctcgaacccccaactccaactgacctcccctctgccagagcaagaccacgagtacccgccgagagcggacctggctggctacacaaagccaggcgcccgaccagagggatcctccgggacgtcctccgccaccggggcgtccccgcccagccccgcccggcgcccggcgctcaccagctctcctccccctcctcctagcctgacagacgctccaggtcgtctagcaagccgccctcccccgccgccagcaagaaggtggcgtctcgcagctcctcgttattcgtcctcctcgggtccatccggccccgccgcccgactttgcgctgagacccaaggggaagccccgaggggaccccgcgccgtaggagggagtggaggagccggcgaaccgcgatggagccggggcccagcacagcgcgagcggctcctcggctgttcgtgctgcttccccagcttcttcaccggcacctgcagcttccgcacctcctggtccgcgttcacgttagagttaacgtcctccatcccggccccgctgcctccgccgcccgcggccctctcgctctcgcagcaacaagggaagagccggaggaaagaggcgtccacgccgctcactccagccgaggcccccgcatatagcagggccaggccccgtcgccagggttcccccagcgcgggtcccgaagcaccgctggccacagatgaacagcctcctcagcgcaggtccgggattcggggaggcagcgccaatatccggtctctgcagccatcttccctccgtccctccgcccaccgagggtcggccctgtaggtgacctcagagcgtcggggatgggcgtggccccgtcgggcgctaagaagacctagcgcagagaggaccgccgagctcccgacggggcggggccaggtgtgtgaggggcggggattggacccggaggggcgtgtctggactgccggcggaagtggaacgcggcctgacctgcgacggaaagccactgcaagcccggaggcgaacaggaggcattccgcgagccgggctgagttggtgaacacggtcctcgttcaccccgcctattggtctgggcgtgtggggtattctccacccacttatacggcgtgtgggaccgacgggcccgtcctgcccggctccggtccggatctcgagtaggcgctcaatgggattcggggagacgtagtttactttgttcagcaaatatttaaccgatgcctattttaatgggagattgtttccgctggcgggagcctcagagaccgcctgtgtcctttaagaaacccgaatttcagacagttaagagaggtctaaggtcaaaataataatcataatttcttcttactggccagatactatgctaagccctttttaattttattattattatattttgtcaccgaggctggagtgcaatggcccgatcttggctctgcaacctccgcctcccggtttaaagcgattctcctgcctcagcctcccgagtaactgggattacaggcgggcgccaccacgcctcgctgatttttgtattttagtagagacggggtttcgccattttggccaggctggtctcgaccctgacctcagggtgatccgctcacctcagccactcaaaagtgctgggattactggcgtcagccaccgcgcgcccggtcgtgctaatcactttgaaaggcattatctcatcggttaaaacatagttttccggacttaaaagtttacagcacactggcgcagaagatggaaaaccgctgcttgcctttctccgtttattgactcacattctgctctttggatcattttcttcggaaaaagttttccaaagtgtgtcttgtgtattaaaagttgtgtattaaaagtatttgaacacgctg

SEQ ID NO: 308 - DNA, 2306 bp, Homo sapiens
gacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggaggcactgggcttatccgcacgccagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcaggtaggcacgagctgcagcggctgccctgggacacaaggtacagatctgtggatgtgctggagggaggttctctaaaaccctctctttgtaagaaggggtctgaagccccccaaaaaaggagacttgtccaaggtcacataataatggctgatgctaataataatagcaattactgtaatagtaacagcctgatggtcaagggtatgggctctggggccatagagtctaggtttgaatcttgactgtgccactcaagaataaaagaatctgtcggccgggcgcagtggctgtaatcccagcactttgggaggccaaggcgggcggatcacgaggtcaggagatccagaccatcctggctaacacggtgaaaccccgtctctactaaaaatacaaaaaattagctcggcgtggtggctggtgcctgtagtcccagctactcaggaggctgaggcaggagaatggcatgaacctgggaggcggagcttgcagtgagcccagattgcaccactacactccagcctgggcaacagagcgagactttgtctcaaaaaaaaaaaaaaaagtcaattatctttgtaagctacatcccgaattcagaaacaaagatgcttcttagaatcaattaagtggggtggtaaagtctcaatactagctattattattaagcatcagcttggtgccaggtattttacagctgtaaccatgcaggttaaggtctcatccccgctaaatgagaggaaaccggctcagggaggtacagcaactgggtggaggctgcccaggtggtggcagcactgggctcgggggtcagtttggtcctgaaactgggttggggacagggatagtttccagctcaaagactgtaaggactgaagcgatgaggccgagggccctaaggccctggcacccggctccccggcccatgtcctcacttgcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggtgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtc

SEQ ID NO: 309 - DNA, 1848 bp, Homo sapiens
ctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacggctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 310 - DNA, 3337 bp, Homo sapiens
cttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccaggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagataaatcaactattcaggaccggcccccacctttcctcaggagtcatttctgttccgcacaggcctgctgaactgggtgctttatatagggtaagtgtttctcattttttgttccctgtcctcaagccttaggggcaaaagaaacatccaagatttgaaatttcttttcttcttctcatctgcatggctgtagccatctctctgttctgcattatcttatgacaaaaaaaaaaaaattcttattttgaagcaaactcaaagctaggtcctgatgtctcaaggcacaggtactcgtacttaaaggtgagtctgaaatctgtggatttggggaactttggaaaaacaaagatgagtggctagatcagggggctcattgggcaggaagaggagactggaaaatgccatattcactgcaagtcaattatcaacttcctccaaggctaaaatagctgaacctgctgcattttaaaccaatcctcagccactttggtgttttctcaaggatttccagggatcccaggcagtaaattctgctgataataggaattggtgtgataaggtgggtgctgagcagtttaagcaccaagattgtagctctgtctggttttgtggagatttactcaactagaagaacagagatttggctggtttttcagtcctggggtgcagggtgcacctgtactggaaaatttaggacctggtttcattctttgagtctcatgttcaagttggttttaatgttatgaagacacttgggacgcaatcctgagggcagctggggggaagaaagtggtcactggatggacttaccctgtagcgagcccatgcatggtttgttctctgatcgtgcatgtgcttggctctagacccatgtaaccatggtgaaggccactgggggattcagttggcaaaggcatagtgggcagaagaatcttgaacaaggagtccagagcaggtcaagtctcctgatacaggttgtgactcatggttttttgtctctgcctgtagcagctacaggtctgtaaagcaaggggagagtgataaggaaagaactcacctttctggggctctctgacattaatgccacctcccatttgctttttgcagacactgtcatctctcaagtacccatcttggagggtacggaccccacatgagggtgaggctctctgcacactccagagtgaggactttaataatctagtggactgtacatgttgggaggggaagagcggggtgccgagggtctggagggagaagaattgactgccccttttgctcttggagttaagcagaaatctaaagagaaggcaaagaatcttgccttcctggcgtcatttcctcctaccatcccaggccatcatttatttattacagccaacagactggcctctttcttccctttgactgggaatgggtcaaaggcggtgcaggaggaggatctggtccagataattcacaagcagggtgcattttcctctcattattgagaactgtgagtgtttatcaagaaggcagagcaggagaagatgaaccagtcttcttcccctcactacccagatctctgcctgccaacaagccccgtgttcaccctggcaaagagtctttacattcagaccaaggagagtgtgactccttctcagcactagctagaaacctcaagcccttgcttaagggccttttccagagagacccaatgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttgatgggcatttcttttaagacagagcagaaaactcttagatactttgcgtccttcctatttgactcagtctatgaaagccaggttagcttgctttcttcctccctaaatcctccatcctcatgaccaacaaagaaatagtagaatcattttccaggcacatcttggggaggatgtggggccattggaggctgtccttcctagataagtctttaggagtgagaacaaggagtcttaccctcctctgtccacccacccccatgaatgggcctggctccagccaggagttgtggtttttcctgagctcctcacctatctcttctggatttcacattggcaaacggggttgcaaagtgctcttcgtgctctttggacagtgccttgtggagaggaatgcccatgcccctgcattccaaggccttggtaagcaagctcagagtagctggatttttctaaagcaattgcagaacacctgctttttctttgtttcctctagaaaggaccaaccacgccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactg

SEQ ID NO: 311 - DNA, 2729 bp, Homo sapiens
acacacacagcgagcgggcgggcagaaggcggttctgctggtctcctcttcctgctgcagccagcccagcgtgcgggccatgggccctgccggcgggtgaggcagccgcgtggcaggcatgttcggaggcccggggcctggggtcctgggagcccagggcatggcgggacccctgcggggccgggtggaagagctgaagctgccgtggtggcgggagagctcaccgctggtgctgcggcacagcgaggcggctcggctggcggccgacgccctcctggagcggggtgaggctgcctacctgcgggtcatctccgaggagcgggagctgcccttcctgagcgccctggatgtggactacatgaccagccatgtgcgcgggggccctgagctcagcgaggctcaggggcaggaggcctccgggccagaccgcctcagcctgctctctgaagtcacctcagggacttacttccccatggcctctgacatagaccccccagacctggacctgggctggcccgaggtgccacaggccacaggcttcagccccacccaggctgtggtccacttccagagggacaaggccaagaacatcaaggacctgctgcgcttccttttcagccaggcccacacgatgaggaaggtgaggcttccagaggtgaagggactcacccaaagctgtgtcaccaggaagtgatagagtccaggtggtggctgtggtgatggacatattcactgacatggagcttctgtgtgacctcatggaggcctcaagccggcgtggtgtccctgtgtacctgctccttgcccaggagcacctgaggcacttcctggagatgtgctacaagatggacctcaatggggagcacctgccgaacatgcgtgtgcggagcacgtgtggggacacatactgcagcaaggctggccgccgcttcacggggcaggccctggagaagttcgtcctcccctgccctcaaccataatagtaccagccccttaaccttggcagtggggtcacctctgcttcctcgctcccggcccctcctccagttccatcggggtgccccagctctgtcccggttcccagagaatgggctcccaggaagccaagagcccagccccctgcggggtcgatgggtacctggcacaaccctggagacagtggaggagaaggagaagaaggcatctccaagtcagagccgtggccagctggatctccttgtccccttccccagagcccgagaagtgggagaccctgactctggggttacccccaactcaggcccccttcggcctggcgagcaggccccagaggacaggaggttgtccccaagccaggccgacagccagctggatctcctgtcccgagccctgggtactgggggtgcccctgagttgggttccctcagacctggtgatcgggccctggaggacaggaggctgtccctaaaccaaagccgtggccaatcagacctcctgatgcagtaccccaaggcccagggttccagagtgccccttgaaaccaactcctcagccagacctgccagacgggcaccagatgagcggcggcagaccctggggcacagccagctggacctcatcacaaagttcggcccattccgtggtgaggggcctgggcccaatggtctcccgatatcaagccctgctcgcacggctggagctgggtctggggatgagaaacggctaaccctgggccacagcaagctggacctcatcaccaagtatcatcagttgcacggggccgggcagggaactgagcctgggggtcccaagggtggccatctcaatggtggtaacagtgacctggtcagggatgagaaacggctgaccctgggtcacagcaaactggacctcatcactaagtacaacaagtccaagttcaagcagctccgaagccgctttgagtcctagccaaaggactggcatcgggggtgcactggcaagggcaggcccctcctctgtccaccgagactctggacttgctcaggtcccagactggggaagggaggtgtctagaaacccaggtcagacacactctctgggctcaagattcttgtgtatacacacacacacacacacacacacacaccctaactagtatcttcttgaatctaggctgtgtttccagccctgtgctgggcctgtagagctgacaggtgggtcacactcagacctggggacagaggtgaaatgcacaagctgctggagaaggggtcagagccatatcaagttaaaggttaaccagttacagagggtgttagaaaacaaagggcagagagtcctggagaaggtggagtagtcagaaaactttcttagtggagatggaggtggcctttgagccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtg

SEQ ID NO: 312 - DNA, 2927 bp, Homo sapiens
caattaggcactttttattgcccacgctgtcataatcctcagagcttggctacgatgaaggagaggaaataggataggatggaattccaagatgcctttagagttcatcccagccattcccctgcttctagatgggaaagttccaataccatccacaagaactttcctccaagtgaggcccttagccctggaagtcaataggcctttgcatctattgcatctaacaagaatcattcaacctcatagaggggttttctcctgtcctttgctccagcgactcagggaagacgaatcttatttgtgttttttcccaggacacggtgggaggggagctaggctcatgcagtcgtgaagacctctggtaccacctggatggtggcattagggatcagggaactactgatttttcaagtgcaatctgactcctctctcagactagcaattcccagaggacagaggccttgtctcctccctcagactgaaagctcctggagaaactgccttccctcacttccctctcttgtcccctgccccttctctcagttgcccagggcagagctttgtccacagagggccactcctgctgtgcatagaaccttgactgtgtcggtgactcagagggggttacaatctgattgggaagtgctaccgtggtctgtcggtgcctccatttcctcttgtgtagaatggagttgtaatgaagattaattttttttttttttttgagacggagtctcgccctgttgcccaggctgaagtgcagtggtgcgatctcggctcactgcaagctccacctcccgggttcacgccattctcctgcctcagcctcccgagtagctgggactacaggcgcccgccaccatgcccggctaattttttgtatttttagtagagactgggtttcaccatgatagccaggatggtcttgatctcctgacctcgtgattcgcctgcctcagcctcccaaagtgctgggattacaggtgtgagccaccacgcccagccatgaagattaaatttttaaaaagcatgtgcctggctcatggtaagggctcagtaaatgagagcttttattgccttcaggacagctggcgcccctcctagctttctgcttatcagaaatcaggatggggagatccagcagcctaagcttagaaaggtagccttcaaaatgagaatcacagaagccagccagcctagcagccctatgcgggtctcgggctgagaccctggtggacaagtgaagtccattatctccaggaggtagcaaggagatcagtagtcagcatgggcaacctcggagatcttcagcagacagggtggcaacgaagatggatttcaagttaggacccaactgccaaggcagggcagagcagacaagggagagtacatttcgttgcttcataacacctgggaggggtatggtggttccttttccagggtgctggtggtcttaaacctaaaagagatgttcatcagcatgctggggggttgtggcagaggctgggggagggatgcagtgacttttccaagatcacggattccataatcacctgaaagaaggggaagggacagagagaggtgaaaaacacacccaggctgagcaaacatccaccttccctgtctttttttttttttttctttttctgaggctgagtttcactcagtcgcccaggctggagtgcagtggcatgatctcagctcactgcagtctccacctcctgggttcaagcaattttcttgcctcagcctcccgagcagctgggattacaggcgcacgccactatgctggctaattttttgtgtttttactagagacggggtttcaccatgttgaccaggctggtctcgaactcctgacctcatgtgatccgtccgcctcggcctcccaaagtgctgggattacagatgtgagccaacgcacccggctacaccttccctgtcatgggcagacatacacccctgggttcagagtgtgttcgtgcatggatggattcagggcacagaaggggacctagaggttggcggctgctgtgaggaagaggagacattgtctccccagttggttctgtcctgagtaagcaccctggatgaggctgagcaggtgacacctggcatggagccaggccctcaggcgagcagggtgggcaagtgggaggaggggaagtgcaacaggactttataagagatgaggcggacccctgcatccttctgccttgggcctccaaggaaggagcaagtgcgaatggggaggtggggcaggaggagggattctgaagctctctggaaaatcctgagtgtgggggagaataactcactcttctttttctcagcatggacttaataagtcatgtcccagcctgggcaacatagcaagaccctgtctctacaaaaaaaataaatataaaaattatctggtgtggtggcgcgtgcttctggtcctagctactcagaagactgaggctggaggatcgcttgagcccaggagtctgaggatgcagtgagctatggtcataccaccgcactccagcctgagcaacagagtgagatcccaactcaataaataaataaataaaataaaatcatgttcactgctaaatatatacaattgtaattggccaactaaacaaaaaatgagctgggtgcagtggctcacgcctctagtcctggcactttaggaggctggggtgggaggatcacttgaactcaggagttcaagaccagcctgggcaacacaggatgaccccatctttacattttttttttttttaattagctggatgtggtggtgtgcgcttgtagtaccagctactcggatggctgagatgggaggattgtttgagccctggaggttgaggctgcagtgagctgggatcacaccactgcactccagcctgggtgacagagagagaccctgtctcaaaaac

SEQ ID NO: 313 - DNA, 3323 bp, Homo sapiens
aagtccggtgggttcgggaacctgtggcccggctctctgcgcgtccccatcccccgtggccccgaccccggccatgaagcgtatcttctcctgctccagcacacaggtggcggtggagagatggaaccgccatgatcagaagctgctggaggcagtgcacaggggggatgtgggacgcgtggctgccctggcctccaggaaatctgcccgacccaccaagcttgactcgaatggccagtccccgtttcatctggcagcctccaaaggcctgacagaatgtctgactatcctgcttgcaaatggggctgacatcaacagcaagaatgaggatggaagcactgccctacacttggccaccatctcctgccagccacagtgtgttaaggttctgcttcagcatggtgctaatgaagatgctgtggatgcagaaaaccgtagtccattgcactgggcagcctcctctggctgtgcctcaagtgtgctcctgctgtgtgaccacgaagccttcctggacgtgttggataatgatggacgtacacccctgatgatcgcatcgctgggtgggcacgcagctatctgctcacagctgctgcagcgaggcgcccgagttaatgttacagacaagaatgacaaagcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtcagaggctagtccagcacccagatctcgcatcccaggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccatcccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcgaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccaacagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagagggagtggctgagctaagggcccgggaggcagccagcctacggcaacacgagaaaactcggggttcgctggtggcccaggctcaggcttggggccaggagctaaaggctctgctggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaagcaatggtatgggcagggcttcacctgacattatggacctcagacctgagaacctggaccctggaatcagcatggatgagaccagaggaggtatggatggaaacaagctctatggaaaataaagcatgaggcagg

SEQ ID NO: 314 - DNA, 3123 bp, Homo sapiens
ggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacataccagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggtgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcgatgctgttaactgcatttgttgtgatggtgcatttgattgaagcagcttgtctttattatgcaagactgtgtagagtttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgagtggaaaaaaataaaatacttttaaatgg

SEQ ID NO: 315 - DNA, 3766 bp, Homo sapiens
ctcgcttccctgggagggggaaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggaaaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagatgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaagccttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggtgaggcctggctctagcacgtgcttctgggccgagagctgcctcaccctggtgccctataccctggtgtggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgcttctgcagtaggacaggagggacatcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcataagcccacatatgctgtgacgctggccaccttttctcagcttctgaggctgcgatgcctcaggaactccagtttacagagaccagtgtgtttacttgtaaataaagcctctgggtggtgg

SEQ ID NO: 316 - DNA, 2688 bp, Homo sapiens
aagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaaggtgcgtcggtgggcactggcctgtgctgagagcacctcccagaagcctggggtcggaaggaccagtctgagggtcatccttgcctacgtgctggaaaaacgtgcctgctgagagagtgccctcaattcccttggtccccagtgcagtgtttggaccaccgagtagccactctattatgtttgggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagtagccagtcagaggaggaggaggaggtgtttggcatcccaaggagaagctccctgggcctgagtggatatcccctaacagaagaggagccaggaaccggggagccagggcctgggggtccgtacccccggccgctccgcagaatcatctccgttgaagaagaccccctgccccagctcctggatggtggctttgagcaacccctgagcaaatgctcagaagaggaagaggtctctgaccagggggtacagggacaaatcccggaggccccacccttgaaactcacccccacatccccccgagggcagcctgttggaaaagaagccctgtgtaaggaggaaagctctccctctgcccctgaccggctcttcaagattgtgttcgtgggcaattccgcggtggggaagacatccttcctgaggagattctgtgaggaccggttctccccaggcatggcggccactgtgggcattgattaccgtgtgaagacgttgaatgtggacaactctcaggtggccctgcagctgtgggacacggctgggcaggagaggtaccggtgcatcacccagcagttcttcagaaaggcagatggtgtcatcgtcatgtacgatctcacagacaagcagtcgttcctgtcggtccggcggtggctgagcagcgtggaggaagctgtgggagaccgggtgcctgttcttctgctgggtaataagcttgacaacgagaaggagcgggaagtcccccggggcctcggagagcagcttgccacggagaacaatctgatcttctatgaatgcagcgcctactctggtcacaacaccaaagagtccctgctccatctggccaggttcctcaaggagcaagaagacacagtgagagaggacaccattcaggtcggccaccctgctaagaagaaatcctgctgtggctgatagggtcctacaaggactgcccccagcaaacctgaggtcacagagcctgccctgatcctgcacacggctcctgcacagatgccacccaccggggcccgcccagtccttttctttgtcagtcactcacctcccccaaaaggaagggaagcacatcccatcaggagagctgctcttggagcatctcagagtcttttctctcctttctctttctagaccccagatgcctgtccctgctttgttgttgttgttgttttccccgacttagtttcctaggggaaagaaacagatgggcttttccagaaaagccaccacgtgccttctccacgcccccttctcctccccttgcccttaggagcctcagcactgctgttgccgtgacaactatgcagggctcgacttgcggcttcctgcaggccaaagacagtgtggtgcccaacaaagcatccgtctcaacaccccgcggcctccccagctgccactagtagcaatccattacccacaggcagctcaacaactcaatgtgacttgggctccacgcctctacacaaaagatgcttccctgccctgttctcctccttcctgttgtgaaagcagcctcccttgcccttacccagctgtggctctctcagcggcttcctctagccccaaaggcctgctcagaataaggacctgcacacaagttgtgtggccctgggcaaaacctggagctgcttgatgttctgagcctgctttcaaatctgcaaaatagtgctctctgccttactccctcgcaggctcgtgtgaaggtcaaaagagaactcctgggaaagagcttagtcagctgaaaggctctaaacaaatgatagttattacatcgtcctctgtctccccatgcaagagaccagaacaaaacaatatac

SEQ ID NO: 317 - DNA, 4156 bp, Homo sapiens
gttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggtgagagaactggaccctcggaaaccctccgagtcccgaattcgttggttcctctagggctctacttctcgcctgccctgttttcttcgctgcactggctccttcctgtacttgcctaattttgcctcacctccttccactccatcccgcctgcaggcttcggcaccctagttcttcccagggccgtccacccatcttctctgccttacctgtgcccgcacccccgccccgcacatctggcgggagcttctggtaacatcttgagccgctcaagagtgagcgagggctcctcttttgagcccgacaaagctgcgtccctttaaagccatcacttcctttctcttgtctgctcaagtgcaagttctagattgtttccagaggttttagtagtttattgttggagtagaggcgtgaagtcttgcaaaggttttttgccctgacatctcttcgtcttgtgtttttacttgcatttggcttgatgatcattgtgtgtattgatcaatggaagaacaaaatctggcctgaaataaaagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgagcttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttttaaagcaaacttgtcctttggttttgcagaacaggcctgctccctctcatctagcccaccatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaatc

SEQ ID NO: 318 - DNA, 2880 bp, Homo sapiens
aaatatatatgtgcccaatacaggagcaaccagattcataaagcaagttcttagagacctacaaagagacttagacttgcacacaataagagtgggagactttaacaccctactgtcaacattagacagatcaatgagacagaaaattaacaaggatattcaggacttgaactcagctctggacctagcagacctaatagacatctacagaactctccaccccaaatcaacagaatatacattcttctcagcaccacatcacacttattcaaaaattgaccacatagttggaagtaaaacacgcctcagcaaatgcagaagaatggaaatcataacaaacagtctctcagaccacagtacaatcaaattagaactcaggattatgaaactcactcaaaagctcacagctacatggaaactgaacaacctgctcctggatgattactgggtaaataacgaaattaaggcagaaataaataagttatttgaaaccaatgagaacaaagacaaagtgtactggaatctctgggacacagctaaagcagtgtttagagggaaatttacagcactaaatgcccacaggagaaagagggaaagatctaaaattgacaccctaatgtcacaattaaaagaactagagaagcaagagcaaataaattcaaaggctaggagaaggcaaataataactaagatcagagcagaaatgaagcagatagagacacaaaaaactcttcaaaaaatcaacggatccaggagctgtttttctgaaaagatcaacaaaatagatggactgctagccagactaataaagaagaaaagagagaagaatcaaatagacacaataaaaaatgataaagggggatatcaccactgaccccacagaagtacaaactaccatgagagaatactataaacacctctacagaaataaactagaaaatctagaagaaatggataaattcctggacagatacaccctcccaggaccaagccaggaagaagtcaaatctttgaatagaccaataacatgctctgaaattgaagcattaattaatagcctaccaaccaaacaaaggccaggaccaggaagattcacagccgaattctaccacaggtacaaagaggagctggtaccattccttctgaaactattccaaacaatagaaaaagagggaatcctccctaactcattttatgaggccagcatcatcctgataccaaaacctggcagagacacaacaaaaaaagaaaatttcagggcaatatccctgatgaacattgatgagaaaatcctcaataaaatattggcaaactgaatccaatagcacatcaaaaagcttatccaccatgttcaagatggcttcatcccagggatgcaagcctgattcaacatacacaaatcaataaatgtaatccatcacataaacagaaccaatgataaaaaccacatgattatctcaatagatgcagaaaaggcctttgacaaaattcaacaccccttcaagctaaaaactctcaactctcaataaactaggtattggtgaaacatatatcaaaataataagagctatttgtgacaaacccacagccaatatcatactgaatgggcaaaagctaggcgcgttccctttgaaaactggctgaagacaaggatgccctctctcacttctattcggcatagtgttggaagttctggccagggcaatcaggcaagtgaaagaaataaagggtattcaaataggaagagaagaagtcatattgtctctgtttgcagatgacatgattgtatattgagaaaaccccattgtctcagccccaaatctccttaagctgataagcaacttcagcaaagtctcaggatacaaaatcaatgtgcaaaaatcacaagcattcctattcaacaataatagacagacagccaaatcatgagtgaactcccattcacaattgctacaaagagaataaaatacctaggaatacaacttacgagggatgtgaaggacctcttcaaggagaactacaaaccactgcccaaggaaataagagaggacacaaacaaatggaaaaacattccatgctcatggataggaagaatcaatatcgtgaaaatggccatactgcctgaagtaatttatagattcaatgctatccccatcaagctaccattgaccttcttcagagaattggaaagaactgctttaaatttcatgtggaaccaaaacagagcctgcatagccaagacaatcctaagcaaaaaaaaaaaaaaaaaaaagaaaaaaaaaagaaaagaaaacaaagttggaggtatcatgctacctgactcaaactatactacagggctatagtaaccaaaagagcatggtactggtaccaaaacagatatacagaccaatggaacagaacagagcctcataaataatgccacacatctacaaccatctgatctttgacaaacctgacaaaaacaagcaatggggaaaagattccccatttaataaatggtgttgggaaaactggccagccatatgcagaaaacagaagctagaccctttccttacaccttatacaaaaattaactcaagatggattaaagacttaaatgtaagacctgaaaccataaaaaccctagaagaaaacctaggcaataccattcaggacataggcatgggcaaagatttcatgactaacacaccaaaagcaatggcaacacaagccaaaattgacaaatgggacctaattaaactaaagagcttccgtacagcaaaataatgtatcatcagagtgaacaggcaacctacagaataggagaaaatttttgcaatctatccatctgacaaagggcaaatatccagaatctacaaggaacttaaacaaatttac

SEQ ID NO: 319 - DNA, 2981 bp, Homo sapiens
agctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtgggcagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactttgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctt

SEQ ID NO: 320 - DNA, 2750 bp, Homo sapiens
gcagacttgaatagaactaaaaggaagaggaagggcaaatttgttggctgcgtgagctgggatattcatctttctcctgatcttggacatcaggactcctgattctcaagcctttgggtttggactggaggcaccagctttcctgggcctccagcttgcggatggcatatcatggaacttctcagcctccaaattcataactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagcaacagatttgggaatgaggaatcgttccctggaagagtcagagagctcgtagacacattctgctggattgcacgagctcctcccctgggaaatccactaagactagaggaaagaattgcttggaggattcagaggctgaagagtggacagacggctttaattgagaaaaagaagcagaaaattgaggaagatgtgaggcatcaatgccagcagacgacatgtgacaggtgctagccacatggatcacactaaatttctgtcatttatatagataaaaaagaatttccaaagagctcctccataattcagcattaaccagctttaaatcatcacctttctttaccttttcaaagcacttttatctagctagctttcactttcagagtggccaattcaggtgaggattctcaatcctgttctgcagctgaggaactcatgctcaaaagggctaagagtttattctcctacatccaaacaccttgcttttccaaatcttgtgctcactttacctacacattttgatttttccaggctgatgacaagttagacatgcagactcctcaggctcattcataatctgtatagacattacaggtcatgcaaatttaagaaaaggctaaaaggtgcccgtttgcacccaacatgttggataatgccccggtaaagtggaaaatcagtttccacagcctcgctctgtaggtttccttggaattgtaaaagcataggactctgcctcatatttatttctatacggcaatgaggatataacggagcagaccgaaaagagaaaggaattttaaaagccatggaaagctgccctaaatgtggttggatatagagaggagagtgctgaaggcaaacagctgtgccctctttgcctttttgctgaggaaggggatttaagccaaaagaacacacgtaaacgtggatttcttaaagttctcactgtaattatgtagccttgggagatgaggaattgtaaagtagatgctggcttaaacaaatgataaatccttgaggtgatgggcaccccattttccctgatgtgattattacacatagcattcctgtatcaaaatatcccatgtaacccataaatatatatacctaccagtatatttctgtggctaatctgaaagccacctgcacccttgtgaagacacccacagagacttctgcctcccctcctaccctctggcctcaagagctccctgggctctcctgttgcaggagggagagggagagcttctttaggttcctggtaaggatctctgaagacaattccttaggcttggataattcccagacatttgctaaaaagcagcatcctccaaagctttaatttggatcacaggaaaatgatgctcccgcctcagattcaaacacagttttatctcacactgcaagctccctggcatgggcaaagtcctcgatgcctttcctggtggtttccaacattaaggacatacttgttcctcctcctagctctctccctcagccaagtccttccttacaatgaattgtcctgcagaactccctcttaagcttggcttctgggacagaaaacctactttctgaaagggtatggggactgtcagagcatgaactggactcaagctcccaattacagagcagacacaaggctctgcctgcaccaggccatccctggatttctgcagctccaggactctcttccagcatctagatgcagctactctcattccagctttgtgtcctgtttgatgcaaaatctttattccttcctgtttcaatccctgttgcatattctgtgtgacaaagcaagaagctggaaatcgagttctgagctttatacccagctctgccacaaatgtgccatgaccttgaataagtcacatgacttatctggacctggattctctcatctgtaaaagaggaagctgagctatactacttttaaaatgtctccagctttaattttattagaatatcagctgcttcctcctctggtttctcatggcaggttgtgcattcttctctggagacaccaaatttcattggagtatctctccttacaagtgtatttccccactagattggcccctcaagaacaaggattgtattttagttacctctgttatctctgtacctggggaggagtgagaaaaggagagcaggaaagggaatggtatagtaccaacatttgttgagcttctattatgaggaattgtctatgctacacattgtacgtaaagtatgtatgattcacagtataaacattataatctggaatcaacctaaatgttcattagcagatgaatggataaagaaaatgtggtatatagacgcaacacaatactatacagccat

SEQ ID NO: 321 - DNA, 4156 bp, Homo sapiens
gagaatgtgagaaaagggggaaaatgcccaggaggaagcaggagcagcccaagcgccttccctcacatgttagtaggcaggaagaggcggagggggagctcagtgaaggagaacactggtatggaaactcttcagaggctccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccggcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccctttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgggaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaagtaaggaaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagac

SEQ ID NO: 322 - DNA, 3905 bp, Homo sapiens
atccgaggctggcgggtttcggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattccttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaggttttatgagacgggtgtaataatatctccacctgtgatttgggggtgggactcttattttgggtagccatttattgacttcacctttttgccaaggaagtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccagcattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggtttttttttttttttgtaattatatgaagaaagtccagttctcataaatattgatcacttaaaaaacttactctttcttgaaaaggtacacatgtaaaatttaggaaaataactaaagtaggggctggaaccataagaatgtttatccgcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttg

SEQ ID NO: 323 - DNA, 3291 bp, Homo sapiens
gactcaccctcgcggcccgcccgggaactctgcgggagtcgcggcagctccgctcccagagacccaggagttgggcccagcgtccctcccggaacggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtctccggggagaaccagaagggcccagcagccaccgaacgggctgcggccaccatagtggccatggcagggaccgggccggggaaggcaggggagggtgagaaggagaaagtgctggcggaaccggagaaggtggtgaccgagcctccagttgtcaccctgttggacaagaaggagggtgagcaagccaaagccctgtttgagaaggtgaagaagttccgcatgcacgtggaagagggcgacatcctgtacaccatgtacatccgacagacggtgctgaaagtgtgtaagttcctggccatcctggtctacaacctggtctatgtggagaagatcagtttcctggtggcctgtagggtggagacgtcagaggtcacgggctacgccagcttctgctgcaaccacaccaaggcccacctcttctccaagctggccttctgttacatctcctttgtgtgcatctacggacttacctgcatctacacgctctactggctcttccaccggcccctcaaggagtactccttccgttccgtgcgggaggagactggcatgggggacattcctgacgtcaagaatgacttcgccttcatgctgcacctcatcgatcagtacgactccctctactccaagcgcttcgccgtcttcctgtccgaggtcagcgaaagccgtctaaagcagctcaatctcaaccacgagtggacgcccgagaagcttcgacagaagctgcagcgcaatgccgcgggccggctggagctggccctctgcatgctgccgggtctgcccgacaccgtctttgagctcagtgaggtggagtcactcaggctggaggccatctgcgatatcaccttccccccggggctgtcacagctggtgcacttgcaggagctcagcttgctccactcgcccgccaggctacccttctccttgcaggtcttcctgcgggaccacctgaaggtgatgcgcgtcaaatgcgaggagctccgcgaggtgccgctttgggtgtttgggctgcggggcttggaggagctgcacctggaggggcttttcccccaggagctagctcgggcagccaccctggagagcctccgggagctgaagcagctcaaggtgttgtccctccggagcaacgccgggaaggtgccagccagtgtgaccgacgttgctggccacctgcagaggctcagcctgcacaacgatggggcccgtctggttgccctgaacagcctcaagaagctggcggcattgcgggagctggagctggtggcctgcgggctggagcgcatcccccatgcagtgttcagcctgggtgcgctgcaggaacttgacctcaaggacaaccacctgcgctccatcgaggaaatcctcagcttccagcactgccggaagctggtcacgctcaggctgtggcacaaccagatcgcctacgtccctgagcacgtgcggaagctcaggagcctggagcagctctacctcagctacaacaagctggagaccctgccctcccagctcggcctgtgctcaggcctccgtctgctggatgtgtcccacaatgggctacactccctgccacccgaggtgggcctcctgcagaacctacagcacctggccctctcctacaatgccctggaggccctgcccgaagagctcttcttctgccgcaagctgcggacgttgcttctgggcgacaaccagctgagccagctctcgccccacgtgggtgccctcagagccctcagccgcctggagctcaaaggcaaccgcttagaggcgctgccagaagaacttggcaactgtggggggctcaagaaggcggggctcctggtggaagacacgctttaccagggtctgccggcagaagtgcgggacaagatggaggaggaatgaagctggggtggggccgttttaggtagagccttaaaaatgcttctgccctggaatctcaaccattgtcttccaagataggaagccaagtgggtccaggccaggagatgggggcgggggcagctgtgtcatctttctggggcccaggaggatctgggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgcca

SEQ ID NO: 324 - DNA, 3789 bp, Homo sapiens
aaagagcaggcgaaagccacggcgtctgcgtttgcaatgcatgctggtccgtgtagttctcagcctgacaccgtcgttcccagaacccagcgcgctctgtgctggcgggcgcagaggcctcccaggaggagagcaaggacctggcaggggctgctgaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctacctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccacagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagcactgactctaccctgcgctttgtggactgcaggaagcctggtctgcagtacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagtgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccgctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtcccattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggttgagaagaatcatctctgcacctcgggtctctgccagaggaagacttaagcatccctgcgacctcacattctagacagagatgaggtccaagggttggcccctgctgccttctcacaatttgcaatagatgtaaataggaccaataaatcctttggaagagc

SEQ ID NO: 325 - DNA, 3626 bp, Homo sapiens
agcacagctgcccacgcggaggtgcgtctatgctgagctgccacagcaaggctgcagtgcctggcccggagcttggtcacgctgacctccacggcaggaactgagagcagcatctactcccaatcctgcataagaggtcatagaaacaccctacagcccaggggggagccagtcccggccaggaggtggcgtcacagttcagagaggtgccaagtgagcagaaaacagctcctggtctctgtagctgagagagacagagctggacatcctggcccgatggagctctgggtgttgttcccacaacagcaacagcacagagcgctgaacacacaccccacagttcactgtccgtggccaggaggccattcaaaacgtgattgctggttgtcaactccaagaactaacaggagtgaaaactcacacacacacacccaagaatgcaggctctgcctggcacgcagggaagtctgccctcgtgcctggggttccttcctctgtgggcatcccatcttcagagccttggctctcccttcccctgagggattactcaccacttccctaagactgccgggctgccctgctttgctgccatggagtccagtcaccaggcagattcattcacatctacgcgcctgagtggtactggccaccacgtaacggagtggacatcaaacagagaagtgggcaacctggaattgggtgccagtcctcgagtccctcatcagccaaaagaaaatcatctcatgaatgcctaccctccagaagtgtcacggggagaccatcaggtgtgtaccagaagcacttcctacgctgcaaagcagcaaagaaaggcagcctctatagcggtttgtaaagagtgccttgcagagaggacacagcctggctgatgagtttccagcagtagagctttaggtatgattgaatcttggagaggaagagactttggttctgttgagcctgctccatgtttcccaaagcacacaccacccactctgccaacaggtaaagcttcggatggaacctgctgtgttctgtcttcttccagctgagccaggcccgcgggccccctccaggagctccgggcaagcagcccctcatggcccgtggtggaactgcaccctcagcactggagagggcggtcgcaggagcctgcgaggaaggtggggtctcagtgctttcgcacagggcgagtggagctggaaatgcagcccccagtagtttcagttattccatgtatggcttttctctctcaccttgcacctttagaccctaatttcctgtgagcaatgtgctgggaaaactggcagcagctctctggcaaccctgggggaaagaagcgaagtggggtagaagcggaagccaggggcagaggctgggtcggtccagccagcccgcgagggctcccacgcagcagaggttccactgagaggaagccggggctggcccggccgggagactccctccatgccccgtgtgtggagtgcccgggcaccctataccctcaaggtggccttgacctctggagacaggtgttggctccttgagtcaccaacagcagggaccagaccgggaggtgtttctgggcgggaagggctgggccaggccaggctccagcaggcccccttgtggtcagaggggttgcctgcaggatgatcggcttgggaaccaaggcagccactccccacatgggagttggacccaggcttgaaggacacattgtcacatcgattcactctcctgggaggcctccttgtcacacaagatgtcctggccccggtgtttttcttcaccatatttctcccaactgtaattgtgtagttcctggggcgcttatctctcaacgtccatctctgtgaaaaaagccgtgaccctccaggataaggtctgtgcgtgagaccccctgtgtggaaaggacgtatgaaagtctcaggactctacctaagagccaggacccggctcaggtcgcagctccactgcaccaatgcccctcagccccaggagagactgagatctctgtaaacagcagagatcagcaatacaggccttgccctgctgaaacttccctctgaaaggaaggataatgctttcagccaagtgcctgcccagagctctgcaggtgtgtggcatggagggcctggtgccccaggaggagctcagcctcctgccccaccagaatggcccggggctccccaggctccctgcgatcctggctctcgtcacaccactctccaatcccacatttggtcctctgtcatgtccatgaggctgtgggtgcaccctgtcattgtttgtatcccctggcgattaacacagtccaggcagagaatcaagtcaacaagaatgaaggagaaagtggatcaatgaatgttgggccctatttaggggctgaggacacagagataaataaaattctatctctgcccatgcagggttcaaagtcaaattgggggacacaaagtaataatcacagtacagtgaaattcatgtgtagagtgaaagtcatgtttaaggaagctttattagggcacatgacaaaatatccatgactatgttttagctggtcagggaaggctccttggaggaggtgacttggaacagtcttagaggaaagtaaaaattccaggcagggatgaacagggctcccaggcagggcacctcatgtgaagaggtacaagaagccagagtggaaatgtgcagagcttactgtggggacctaagggtggcacgtacaccgttggagccagcgcaggagctggcctggggtgccagaagggatggaagaaaggttcccaagggggttggaatatcaagcaagggataagttgtggggtggcgaaaggattgtaagcagaatgcttgactccccaggggtttttttccaacaggattctctgacggcattatagagagaggagaggaggggaagagcctcagtcaggaggctctgtgggatgctgttgccttggtccaagcaagagacaaggcaggccctgagcaggatgtggcggggggctggagtgggaggacggatttcagagatatttaggagaaagaacttggggcgcaaaggagaggtggggagaaaagaaggtgaaggagaaataaggtaaaggggaacagaagccaagcatcagcttctcctgcctcttcttctgcaatcctcactccccaagcacggaccagccaaggacaaaggcccagctcactggtcagcctacacatgtctcagctattcttctcatgaaagaggatgttttagaaaccctgacctgagctgggtggtcttatttgtaacaatattgtagatggcacatagaggcacttggataaatactgaatgaggccgggtgcaatggcttacgcctgtaatcccagcactttgggaggctgaggagagcagatcacttgaagccaggagttcgagaccagactggccaacatggagaaaccccatctctaccaaaaatacaaaaaaattagccaggcatggtcgtgcatgcttgtaatcccagctacttgggaggctgaggcaggagaatcacttgaacccaggaggcggaggttgcagtgagccgagattgtgccactgtactccagcctggaagacaagagtgaaactccatctc

SEQ ID NO: 326 - DNA, 2532 bp, Homo sapiens
cactgacatggagcttctgtgtgacctcatggaggcctcaagccggcgtggtgtccctgtgtacctgctccttgcccaggagcacctgaggcacttcctggagatgtgctacaagatggacctcaatggggagcacctgccgaacatgcgtgtgcggagcacgtgtggggacacatactgcagcaaggctggccgccgcttcacggggcaggccctggagaagttcgtcctcattgactgtgagcaagtggtggcgggcagttacagcttcacctggctttgcagccaggcccacactagcatggtgctgcagctgaggggccgcatcgtggaagactttgaccgggagttccgctgtctgtacgctgagtcgcagcctgtggagggcttctgtggcggtgaggacccgctgtctccccgggcactgcgtcctccccctgtggccctagccttcaggcctgatgtcccaagccccacgtcgtccctgccctccagcaccagcctcagcagcatcaagcagtcaccgcttatgggtcgctcctcctacctcgctctaccaggaggtggtgattgcagtgatacgggtgtggtgtcctcgtccctgggtcctgcccgccgtgaggccagtggccagccctccctacatcgccaactgtcagaccctaaccacggctcccctcctgggctctatagggccaatctcggcaagctaggggcatacccatggtcccagtcctcccctgccctcaaccataatagtaccagccccttaaccttggcagtggagtcacctctgcttcctcgctcccggcccctcctccagttccatcggggtgccccagctctgtcccggttcccagagaatgggctcccaggaagccaagagcccagccccctgcggggtcgatgggtacctggcacaaccctggagacagtggaggagaaggagaagaaggcatctccaagtcagagccgtggccagctggatctccttgtccccttccccagagcccgagaagtgggagaccctgactctggggttacccccaactcaggcccccttcggcctggcgagcaggccccagaggacaggaggttgtccccaagccaggccgacagccagctggatctcctgtcccgagccctgggtactgggggtgcccctgagttgggttccctcagacctggtgatcgggccctggaggacaggaggctgtccctaaaccaaagccgtggccaatcagacctcctgatgcagtaccccaaggcccagggttccagagtgccccttgaaaccaactcctcagccagacctgccagacgggcaccagatgagcggcggcagaccctggggcacagccagctggacctcatcacaaagttcggcccattccgtggtgaggggcctgggcccaatggtctcccgatatcaagccctgctcgcacggctggagctgggtctggggatgagaaacggctaaccctgggccacagcaagctggacctcatcaccaagtatcatcagttgcacggggccaggcagggaactgagcctgggggtcccaagggtggccatctcaatggtggtaacagtgacctggtcagggatgagaaacggctgaccctgggtcacagcaaactggtcctcatcactaagtacaacaagtccaagttcaagcagctccgaagccgctttgagtcctagccaaaggactggcatcgggggtgcactggcaagggcaggcccctcctctgtccaccgagactctggacttgctcaggtcccagactggggaagggaggtgtctagaaacccaggtcagacacactctctgggctcaagattcttgtgtatacacacacacacacacacacacacacaccctaactagtatcttcttgaatctaggctgtgtttccagccctgtgctgggcctgtagagctgacaggtgggtcacactcagacctggggacagaggtgaaatgcacaagctgctggagaaggggtcagagccatatcaagttaaaggttaaccagttacagagggtgttagaaaacaaagggcagagagtcctggagaaggtggagtagtcagaaaactttcttagaggagatggaggtggcctttgagccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtgaaaaaaaaaaaaaaaaaaaaaaaaaag

SEQ ID NO: 327 - DNA, 3153 bp, Homo sapiens
attggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagagtccagacacatgagggaagacatggagtacataggcctggactcaggtcggatccgcacaagacggcaaagctctgggagtgccaccaacgtcgcctctacacctgataaccggggccgcagtcgcgctaaagtggtttcacagtcccagcctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttggagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattactccaataaaagtaactagaggtttggagtctggttaaataaattctgagtaaaattctt

SEQ ID NO: 328 - DNA, 2424 bp, Homo sapiens
aaattacccagtatcaggtattgtctttattagcagcgtgagaacagactaatacagtacactacaatttagacttctagtgactatacctggagccccctgttctccacctctctctcacaggtacacacacaaccatccacttattgaagaggatgagcaagggcacagcctcaagcccactgcctgtgtttgaattctgagtggtttgctaactatgtagatttgggcaaatcacttaaaactcgttttcttgtctgaaaaattgatagtaaaggtgcttaccttgcgggctattgcaaaggacaaaataaagtctagtatgtgtatttgttcgtcactgcatttccagagcctagaacagggcctggtgtgcagtaggtgcacaatgcgtgtccgtggaaccagcagcaggccctctacctgcctgccagtgcaggcactggtcagtcaccatgacaaagctgatctgcctgcccctcacacacttgctccccaatcccttcacttggtgacagccttccccgacacccttgggcgcccggcccctgggacgcctgtggagctgttggggagaaggaaatctgaggcccccacatcctgacccaggaccagctggccttgcggattccagaactttctgaagcagccggccggccaccagccaggaagcggaaggtgcagaaatagaaacgcacagagaggcaattgctccttttgccctgcaaggaagggaagccgggggagaggggccaggagaggaagctgaggggcagaggagaggatggggaggccaaggacggcgggatggggttccagagcttgccggacctcggcccccgcctgctcccatgtccagtgccctgggtcagggctgtggggagcagctttcaacaccttcattttcctgacaagatcccaaaatgaggagctctgatttgctctgaatgcgacttgaagccaggccccggggaaagtatttgtggcaactttcaagggttgatgctgtggctggcagcagaggtggggggcaggaggggggtgctcacaatggtcgttggctgactgactgactgaatgaatgaatgaatgagtgagtgagttgtggccagccctataccccagcagagccactgggcttgaggacaggaccctgcctgctggccacgtacctagacagccacagacagaaaacacgcttagcaggctgcactgaggcggagaaatgagatctggccccagctcagctctgctgcatcccaggtcatccgaggatgtcactggccttctcagcctcacaccccttcctcccagtctgggagtatagcaggaggccccccaaaagtgtcctctagtccagactcccccactgcagccagcctacattctagagctgacatgggccaagaccaggaaggaagggccaccttccctgaaggacactgactcctcaacccctgtgctcagccgaccttgcgaagttggaaacacactgccctcctaggctgagctgagcccttcccagctcgcagcccagcgggtccctgaggtcccatagagggggctggcagtggcttcttccaggcagggccccaatgcccaccacccaccttggaaggtctggctggaggggtctctgaggacagggaccatgacaaggttccccttgcctcccccatgctatggccctggccctcctgcagagcccacggtcctggcaggggccacacaggatccctgcacccgtggcccaaccacaggctcggccaccatgcacacggcacaagcatctgctccctggccttcctgacaggcagcgggcgccctggcactggcgggcgggcaggcggcgtgtgcaggttggggccgcccaggggcaggagtgcaggcctgcagttgacaaggcctggtttcctgctctcactctggggaggaagaggaagatgacaagcaaaccagtgcttgtcaaggagtcatctaaacacgcactcagaggccacttccaaagaccgccctgaggcagtccagggtccatcgccgaccaccctccccaaaaaagaatgacatcagccaggtgacagcagcaggcaggtacagatggggtcctctagggatggcagattgccagggagcctggtcacccttccctaagggtcaactcagtttttcagccatggaccaaggtgcccctttgtcctgtgaactttgagaagcagagggcccttctctttggagtctgagagaagcccaggagaagaaggaatgaaaccctgcacatctcatcttcttaaaatgcagattcaggcctgtttttccaagtccatcaccaaacacaaggtctttccaaattaggtgctgagctgagctcatattcccaaaatgcacactcccctccttttttttttttttttgcttgggaatgct

SEQ ID NO: 329 - DNA, 3203 bp, Homo sapiens
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacactgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcaggtgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacagggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcag

SEQ ID NO: 330 - DNA, 2611 bp, Homo sapiens
accggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaaatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcacccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggtcgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctc

SEQ ID NO: 331 - DNA, 3652 bp, Homo sapiens
tttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcggagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaagggattataccaaagctttgaagttgctggattatgtgatgtgtgattatcggagtgaagggtggtggactctgctcacttctgtattaactacagctctgaagtgctcctacctcatggcccaattagaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatacttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttggaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttc

SEQ ID NO: 332 - DNA, 2606 bp, Homo sapiens
ttacttgtctggacatgcacatctctccatgcatagtgtgttgagaagtccccaggagttctttcagctactcagcccacctgttcccagagacctcagaacccacttccagaatctcttgctccctgaccctgttcttttaggtagagtgttttctttctcagccttgggcacccccatgagatagtgctgtaccgcagttctggcggtatgtagagccatgacctctaagcctgcagatgctgaggggtcaggttgcgggcagccagtcagatctgtgcctccgagaactactgttcttttctctgattttcctgacctacctcatcttctctattctctaatagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagaggtgagccttcctgccctccaatccagggccttacattgaataagagagaataattttgtttttccgattatcttgttatgctcttccaggcccatgtgctgtggacaccctagagtcttgtagagtgtgtgcctcagctagttggagatggagcagactccttcctctgggggcctttgcctcaggttaccctgttttccctccatactgatgacccaatagagtccctgggcccctagtgaacagtgcctattcctgtcctcttctagatttgcctgggtctccttgaatagtggccacactggctttgtcctccagtggagaatctccttgtgtgtgacccagatccatcatctcttctttcatccatttattcagcagctcttcactgggagctgctctgagccaggcactgtgccaggtgttagggaaacagacaaagtcctagcctgtcttttgcagccctcccaactctgggctgtgggtttagggatgcaatggtgggagggcagctcggctgagacaagcctggcaccctcccctgtttccttacgtagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattctgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaac

SEQ ID NO: 333 - DNA, 2420 bp, Homo sapiens
taacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccacctgcccgcttcatctggaagcggggttccgataccctatcccacagccaggacaatggggttgacatctatgagcccctctacactcaggtcaggatgggcagctggctcgccccataccacttctcctgcatccaacaggggaggggggcatggggctgagtttttgggactgccttgacttcaacaattctattcttactttggaaacacacattctgattggagctcagacagcctggggcagaaaaatcagatggaaaggtcagggagcagcaatgagggcaggagtgtccccgaggcaacatgtcctccaggaacattgctagttaggaaaaggcacccctaggggcagacaggtcatcccagtctgctgctgggtggcagagtattgggaacctgtggccaggcacagcaggatctgggggcgaggagatgactcctcttcccatgggccctgatagtcccaggagatggtggtgatgccattctgccaaggagggctttcagcggtggctgcaggccagccccatgtttgtgtgggttgtacgagtaagttcccttcttacccctccgtttcccagactggagaaaccaaggcctggtacttgccagtgtgcacaagggcaacctcagacccagagaatcccatgatgaggcactgccaaggctatggagagtgtagcatccaccccaggctcaggacccctggggctaaatggtgagggtggggttggggatggaaagagaggaattagacaggcatttgtggtaggctctggtgctgggtgaatgagtatgcgggatccctggagactcaagcaggcacctcaccccagtggtccactgctgcccagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagtgtgagtccaccacgccacccggactaccttcccagctttccttctggctcccagccggcctgtcccctcttcatcctctcacccaccccagtccaaccaaaccccaccagctactcctgatacccctaatgctccttgacagccccatgctgtaggacacggaggtctgtgttctttgctccatttcatcaagtatctcccatcttcattttcagggacccggtgaac

SEQ ID NO: 334 - DNA, 2728 bp, Homo sapiens
attttttttttttttttgtagaaagacctttaatacttctgtttacaaaattcaggcatacatttcagtttgccctgaaccgtgcccaaggctgtgtgctcatctctgccaggatgtctgtgccctcatgtactactgacgtggagggtgcagagcagagcctggggtctggaggcttcgctgggcctcagggggaggggaatgtgaatgtggcccggcccagaggaccctccatttcatcagttttggattgggcaacagaggaagcagatgtctgggctgcagacctgctggtctgggcaggggtttgggaaccccggggttgcctgccatggtctagaggagatggctgcggctacttcccacagggtggggtggccactaggggcttgaagatttgctcactggagcctttgtgcttggccctcagcagcacagctagggctgtggtcccgtgcaaggtgtgctgagggttgtgtaggtggctggtggtggcagcttgtgccagagtgacacaggcttctgtgggcctggctgggggcagttaaaaagccgaaaaggtacttggctttgtgagggcaaggcttgggaggcggggccctgcaggacgtcatgttctctgtcctggttaggaggggggaggtgttggggcggggaaggtggggcagatcccaactggcccctgtccctgggctgcaagctgacagcaggccagggaagcagtgaggccttctgccctggccttggggagaaggagtgcatgtgtgaggctgggatacagtggccctggagtggggctagggctcatcgccagcaccaggcgcggggaggatttaaaaccagagtcctgtctctgagccaccccacagggacgcttgatccaagcctgttaaggccgtggaactcgagggtaggcagtgggctgggccaccgtgggttcaggatggaggtgtgggggctgccctggaggaacgttagtgtttctgagagcaccttagtgttgctctgcctcagccagctgggcaaggagttggggagcggggaggaggccggcgccatggagtggggaagggagccgtcactgttggggatcagccgctagtgtaaacgagcatctccacccacccagataagccccccacccaagtgtggagccctgctcagggagtacctcaagggccccggcctgggtggtgccagcaggcttggacactgccctggcagcaggggccccgtggaaggcaggatacccagcagggggtgccacccagtgtggatggaggggcagggcgggggcgcccctgagtcactgggcagaggcacgagcacgtccacatagctgagcaggaagaagcccgactggccgtccagcatgccctcgtatcagttctcgttcatctggttgatcagcatgaagacatcgccctcatggaagcccagctccctatctttctccggctccaagtcatacagcccttgcagctcggctggtctaggggcggcatgctcctgctaggagtccagatggacttgtcgtaagatcggaaagaggacgaagctgcgatcttggggactgtggtgcaggggaagccccggttggactgctcaggctttccgaggtcaaagcactcccggggcttgggcttatactcccgcctgggtcgtgaggaagcttcccggatcctgcacttgaacttctgggccagctggtccaggatctgcacggcctgccggtggtagtccagctgcgcctccgccaaggccgggagttgactcacctactggatgtcggtctccaggaggttgtgcatgctggtttctgccacctccttggactcctcaaacttctccagcgcctggtgcagctcctcttcggggatcttgccctgccgcttcttttagtcaaagtccaggcggcggccctccagcttctgcaggtggtgctggatctccttcaggtctttctcacataggttctggagggggtcaatgaagttatgcttgacctctatgtccagggagtccttcacctctgccaggtgcttcatgggctcgccggcatccagcagtgcattgctgaagttggactcgtcgcgcagctccttcccatggcggatcaggcactcgcccaggagcccccctgactgcaggtagccggggttcttcacctggccccggatcttgcacgcggtgttgagcatggtcagtttagcctgcgagactgggttgggctgcgggtactcgatggtcctggacagtacttacgtcaccgccttgctgatgacatccaccttctccatctcttcgaagtcatcatacagcttggtcccctcagcccctccgaccttctcactgaccagttggctcgccttgtagaactgcttcttcagcccggcaaccgacatgctgcctcctgccgcggaaccttccgcccagacccccctgcccagaccccgccagcgacaggctcccgggcaccaccaaccctctgcgcgcctcagcggcccccatcagcaccgcctccaccacccgcttgccagctcggcgcccgccccggcgccgcctcgagttcatgattctttagtctccttcaatctagatctgttcccaggattgtttaaaagcatactgacaaatctttgagactgtaaatgacctgaggtatacattatctttacttgagaatagtaatttttcaatatgcattaaagatcattacacatgagct

SEQ ID NO: 335 - DNA, 3731 bp, Homo sapiens
taggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaagctgagctgctggacaagttcccaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagtgagagtggcagtaccagcctcctggtgtggtgaggatggaaggagtgtgtagcctgctgggaacatcatggcgcccgagggccggatgggcatttggcagcctctgcgcgaggagtcctcgcagtggttatgcatggtgctgggagcggagcgctggcttcccactcttcaggcgaggcagtggagcgggttgctcttgccagagaggttcctagtagggtcgcagagaaacgaagcggcacggcgaggattgggacccagggctgactccagagcccgagggccttccactgctccacaaacagcagcgcgtccctgtgcaagttcccaaacctgtgtggggctcagcttgcttttcaggaagggggcgggcaggggagcagccgactcccttagcgccttcggccccggagggactggaggcctggaggggcctcagcgccgccgtgcccacctgtccgcctccagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgaataagagtggggatgggccggtccgacccttgcgttctgcctcccgccccgcctgcctgcggcgacccaggctgccgactgtacttgtgcacagccccgtcctgaggcccccatgtggtcggggcccacgagacacctgcagaggaccgtgtggtcgtaggagcctgcatgcgtgaccgctgcacgtgtacacccacacagaaccctcatcactgggaattcctgtcttcagcgtatcctgtgctggggtcgggaggggctggcttggtcccttggcctttctgaacttcattacctctcctaggggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcgttgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtctgcctcagccacctccctgacgctgtcccactgtgtggatgtggtgaaggggcttctggattttaagaagaggagaggtcactcaattgggggagcccctgagcagcgataccatatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaaagtagaaaaaaatgatatctg

SEQ ID NO: 336 - DNA, 2887 bp, Homo sapiens
aaaaaaagggtttaccaatgagacacatgttgcctccttcatggaaaccctaggagaagaaacggacagattccccttccctgcctccgccccagcccagccccagcggtccgtctcactcggttgttgctgtaatgctggtctcctgtctgtgtgcggcactgcagatgtggcgggcaggggcttgggagctctggggcaggcgctgaaggcaggagaagggccagggaatgtcgtcccagccagcagggaaccagacctcccccggggccacagaggactactcctatggcagctggtaccgatgagccccaggggggcgaggagctccagccagaggggggggcctgacgcaggcctgagccagccttcatttgctctgcagggaagtgccctcctgccacaccagcataccacccggcctgtaccacgcctgcctggcctcgctgtcgatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagctccagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaaccgtgctctccgaggacaagcaggaggtggtggggctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggggtttccctaccctggctctgccatcagccttgaagggcctcgatgaagccttctctggaaccactccagcccagctccacctcagccctggccttcacgctgtggaagcagccaaggcacttcctcaccccctcagcgccacggacctctctggggagtggccggaaagctcccgggcctttggcctgcagggcagcccaagtcatgactcagaccaggtcccacactgagctgcccacactcgagagccagatatttttgtagtttttatgcctttggctattatgaaagaggttagtgtgttccctgcaataaacttgttcctgag

SEQ ID NO: 337 - DNA, 2712 bp, Homo sapiens
ttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagtatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 338 - DNA, 3370 bp, Homo sapiens
agttgagactgtctgaaagctctgcgatccgaatgtgtgttatatttcactgaaaagaggagagagcgagagtgcatctccctctctcccaggagtttgaggggggggggggacagtccacgctcatctcgcccacccagtgaatgtctgctcttcaccccctttgcacacactctccgggttgttgttgcctttttttttcttggaggggggggtgctttttgtgtatttttcaaatttttttctgttggaagatcaagaccggccaaaaatccatgatcaaaatgtgtttgcattagatttcgcattggaagaagcggcgatcctggcggccaagccccccgggtggaagcgcggggcaccaagtggcgctccggcggggtgacactgtttgatctgtgactgtttggaaggtggagcagcgcctgacatctccccccggcgcatcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgcggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 339 - DNA, 3833 bp, Homo sapiens
ttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgatatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctggtctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgactt

SEQ ID NO: 340 - DNA, 3015 bp, Homo sapiens
agaagcgccggagcgccgcgtgaggagcccggccgtgagtgcgcgagtgtgccatggccgcggccaccaggcgcgtgttccatctgcagccgtgcggtgggtgcctgaacccgggggcgcggcgggaaggccgcccgggtctccaccaccgtctcccgtcggggaccccggggagaacgcggatgccgtctgcctgcgcgggccggggccgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgcccgggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttataccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaacctgtcaggcctcggcgccagcctcaacgccagcctccacactgccctcaatgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcgaggagcagactgcgtaccccccgacacactacatccggagggtgccccagaggaagatccactacttcacaggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctg

SEQ ID NO: 341 - DNA, 2299 bp, Homo sapiens
acttccggttgcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccaccgtcagattactttgtgggtcagaagagaactggtttttccagcagccaggcatggagcagacctgggccggcacagagtgacccagggcagtgccctgaccagtgccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatcctagcatgcaggtgtctttattccaagggttcagcttccagatcagccgatggaccataggtcaggaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctgcactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgcgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaacc

SEQ ID NO: 342 - DNA, 3268 bp, Homo sapiens
agagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggagccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgccaggggtccctggagcagccggcgttgggggcgctggaggtcgggaaccgagtacagcgtcgggcgggggacagctcaatcgagctgggagcattagtacccttgattctttagactttgcaagatattcagatgatggtaacagggaaacagatgaaaaagtggcagtcctggagtttgaactacggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgaggtatgtcaacacatgcctctgttggtttcaattataatgattttttttttttttgcgaagaagaagggaatttttttaataaaaaggctttgcatatc

SEQ ID NO: 343 - DNA, 2604 bp, Homo sapiens
caaaatcggttctgaactgcattttcatctcagcgtttggccacgggcaatgagagcttcattcagaagagtcacaaaatcgttctgaccaagaccattttgtctagatcagtaatttggggatttgcctgtctcagtgccatcagaagcaaccacctaacccagaaatgctaacattcctcttctttcagcagtcactgactacctacatccctcagctccctccccatctcacatcaccctcaggggcctctgagcacagcatcaccgagggggccacagcagcagaacctcctacccagatctctctaggcactgccatcatgtgactaaactcccctctcaaccacaacctccagctacagggctctcatccaagtcaaaaatccaaagacaggcgtctggctggctgcaggagtccagagccatgagtgtccctaaattagtcaaccatggctgggagacagagccatgcaatccagacccagctcttctgctcactggggccgttcccggagaaggagaaaccacgctggagcgggcactcccacgagttgtcggggaacaagaactcggatcctggcgggagagagcgaacagtacacccgagcggcggctgtcacccgctttgaaacacgtaagtgcccggccaaccagcatcccagaaacgcctggggagcggggcgcgcggacgaggagagaccgcgctgggagggcgcggaagggcgagggcgctgccgcctccacgctgagctcactgcgcggggcggcccccgaggcagggcgcggggcgaggcgcccgagtggtccgtctcgggaggcgcagacgcggttcctctcgagggcgctcccgctgtgaggagcaaatcctagggacctttgcgtcatgagcacccaacggggcccgcccccttaggacctgcacctgcctgaggggaaaacccgcccaccacccacggtcgcccgcagcgcttgcctgccagccttctcatctgcaagccgcctcctccctgccaacctcctcctccctgcccagcctctttctctctgccagcctcctcctcccccatcggccgcctcctctcctgccagcctcctcctccctgccaacctcctcctctcctgccagcctcctcctccctgccaacctcctcctctcctgccagcctcctcctccctgcaagcctcctccttcctgccagcctctttctccctgccaacctcctcctctcctgccagcctcctgctccctgcaagcctcctccttcctgccagcctctttctccctaccaacctcctcctctcctgtcagcttcctcctccctgccaaccttctgtcctgccacccccctcttccctgccagtctccccctcttctgccagcctcctcctcccctgccagcctcttccttctcaccagccccctcctcccttttcatctaagatcatttgacctgtcattcaaggcctagttgaaatgtcacctctgtagaaaagtttctccccagttctctctgatagttagttctttctctcctttgagtggggtagcatggtgcacatttctatatcaagcttcttggcccggttttggtatttacatgcttatctctcccctgcaatagggacagtgctaactttctgtcacatttctttttaatgccttcctaaaagagtgaccaacacatgggtgatattcaacaaatgattgaaaaagaaaaaacaagaaaaagaaaaatgctgtttataatcaggttcaggggagactatgagaatataaataagacataagaacatcttgttataagagaagttcatataaaatacatttcaggcacagactagacactcaataaatattgcctgaaaatgaatacaaagaaagaactcaaaataagaggctttggggaatcattatatatatataattataagggaattggtttttttggtctctaactttctaactttctaagagtaacaactggaaaatttagaaaataaaagtatgaaaaaaatataaatcataccacttaaaatttaggcatacttcttaatcttttatggtgtgtgtgtgtgtgtatgtgtgtgtgtgtgtgtgtgtgtgtccatacacattaaacatacgtaatatagatacattaactgggtctaaatggaaaggaaagtaacatgaagagcttgctgccatatgacattcgtaatttattatatgttggtcttttttttctttttaaaagtctttccctctttcctttgcatttgaatataggttgtttgttttgttttgttttgttttttgagacggagtctcactctgtagcccaggttggagtggaatgacacgatctcggctcactgcaacctccacctcccaggttcaagggattttcccacctcagcctcccagatagctgggattacaggcacccaccatcacgccaagctaatttttgtatttttgtagagacagggtttcaccatgttggttaggctggtcttgaactcctgacctcaggtgatctgcccaccttggcctcccaaagtgctgggattacaggtacgagtcaccatgtctggccatatgtgggtgttttctaattt

SEQ ID NO: 344 - DNA, 2496 bp, Homo sapiens
gtgctgctgagccgtgagaatggcgtcccgcggccggcgtccggggcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttggggctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagccccaagcctgcctcgaacacctgtgtgccacatccttcagggagcacccctgcccggcttcacgtgaacacagaaatggccaaatgtcctccaggagaggaaaagggcccacggataagaggaggagccgctggccgccggcgaaagtgagtccaactgggaggcatcaggagacaggggtcttgagtccacctttgccgctgacatttatgtgacctcagcctggtgttttcccctctctgggactcttccttccctaaaacctgccttacaaggggtctgtgtccaaatactgtccagacccagcactaggggtcatggacgtagggaacatggtgagggggtcatggcaggagggatggggcctacactcaccccagaggcaaagatggcggggttcccactctccagcatgtcctccagctcctcactggtcgtggtcctgccggctgcaagcgagtggggtcacactgagcccagccctctccggggagttcagcagcagcattgggccccgccccctccgtcccaggcccgggctccccccagccccgagctcagcggcagcctcaggccccgcccccccggcccttaacacagcagccgcctcaggcccccgcccctccagccccaaactcagcagctgcctcgggccacccgcctcgggcccctaactaagcagcagcctcgagccacgcactcagcagcagactcgggccccgcccctccaggctccaggccccgccccaggccccacccccagctcactgatctccagctgcctctggatgcggcctttgcagcgctcgcggtagtcggactgcgtggcgttgtactccgacatgacctccacaaactttctggacagcgtggagtgctgggggcccgagatggaggtgcaggggtcaggccctgcggggaccgacccagagactcaggtgcccgcccatcctagactccgtggccgcacctgtgtcttccggatcctcaggtcagcggaggagcggttcaggccttcctcttgctcgatggactgctcgatgcctgggggcacaggtggctgctaagtcataaccaggccccttcaaccccgtcccctacccgcacacccagcatctatccaccttcccacatcccctagggtatgtgtgtggcctgtggctggtgggatcagtgccaggcaccgatggaggaggggcctacagaagcccttccagctgtgacgctgtgtggtgtgtgcatgtgtgtaaatgcacacccactccaagctctgcgtgtgtgtgaggtctggtagctccggccaccctatgcctgggtaccactccttttctgctcagaaaggctgtgtacgagggaccatgcccacagcggggagagccaggtggcccctcctgcagggcatgtggccccgaggccttggcactcatggggtgcacgtgtctgttcacccagaataccgggcttctgcaagagaccaggaagtactggccacttcttcaaccctctttagcagaggtgaggggcagtgcccatccagagtggagccctccctcgccaaagccttaggtgggtgtgtccctgggcccagcccagagtctggcaccaacgggccttgccaagtagctgctgagtgaatgggcacatgacgccaccctcagaaaggaaagcaagatccggcgcaccccctcagggcgagcaaaaccccatgggctccgcagaggaagcaggcctagaatgccccccacccacccccagacaagcctgactcactctttaacttgg

SEQ ID NO: 345 - DNA, 2675 bp, Homo sapiens
ttgttttgctgaccccttttgcttactctgtagtctttgccctttttccattcttttgtttgcttctcatggtgttttcttttttgtctcttagtgtggttctttctttcactacggtcttggctctgctgcttttttgtatgtctgtggcattgcctgagtctcagtttccttgtgtgtttttctccctgcctcctgtcctgtgtttatctggtggctacaagcctaccagccacatatcagcatagaacctgaaactcctttcccctacaccctccttcctactctgattttagccagtgcatttgtcccctaagcaatccttctagctggttatgtcctgactgttgcctcatgccaggacccctcctccctcctcatgtgactgctaccttcctccccacaccagtctttgcttccctgtgctacaagaggactagggtggacttctgggtttaaagaggagggaatctttgaggaagcttgaaagataacctaagagtccaaaaagcttggctgtatacatgatgagcctgtttgattcagtggaagtggaagcccatgtgtgaacagatggcctttgtctgtactagtacacatgacctggggactaggttgtgacatgggccagtgttgccctgttacttttgggtgggagccgtgaggttgcctggttgaggtactctctctcctagtagctactcatagccagcttttagtcctggtgacactcctcttcattgcctccatttggcaagtggatcctcaactgtgggctcttagggcagggtgggactcttgagagcctttggaaaactctactttttagagaggactggatgacctgctcctccatgagttctcatagaatgtttgatgtctccaactgtgtgatgatgtggggagggcttcagacaggaagatgatcacattttttgagtctgagaaggactgtttactcattctgttgaatcctctatttttgttgttgttgccattggccttggctaggcagggtcaggatgtcttctgtcttttaattcctaccaactcagggccccttctcttccgattccagtgcaggatgagggatgagaagggtgccatcctctaagaagggcaaagtggggtcccccacggacagggcctgagtgaagtggtcctgaagcatgggcagtctcctttgaggggtggccctgtacgtagagtggttatcctgtgtgttctacattctacacatggctgtgttggtgctggtattgactgagtgtctgttgggattttttggattgtggaggatctcaactcagctccatgtcttagttcccatttcatcagaaccaccagaggaaggagagaaagaggatcttagggttcagctgaggcgacaccatccctcgagtccccttcctggcagtaagacctccaaacgaccgaagatcaaggtgtcccttatctcccaaggggacacagctggagggccttgtgctccttcccaaggaagtgctccagaaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggtatcttgtggcccagcattctccccttccaacacagaatttttggtctgctgcttctgggtggtcctgggaaagcatccctggagctaaatccataggatgggcctctgggtcttagagtgatcatagaggcttgacgtgaagctggaattagcttgggcagagggattccttggccttgaataaatgcagtgagtaaatgtcctggtctgcaagtgagtaaatgttccagtctacaggtgctgtatcctctactgtaaggagaaatagccgataggacatatatgtatagtcagcctttcttatccacaggagattggttctaggaccctcaccactaccaaaatccatggatgctcaagtcccttatatgaaattatgtcataccgttggaattctatatccacaggtttctatccgtggttgtttgaatctgcaaatctgctgtgaagctcacagataattgagagctgactgtggttttactttgctgttttaagcacatctgcctgaataaaactggaaatggtgctacactgggcattagcaaaatgagacatttttctgtctgtgcttgtctctctctttgtcctacccactaaccctactttgaaaggcctgttgcctgagcccagcagggccaaggcattgcagaaaccctctcctggccaggcatggtgactcacacctgtaatcccaacactttgggaggccgaggtgggtggatcacctgaggtcaggagtttgagaccagcctggccaatatggtgaaaccccgtttctactaaaaatacaaaaaattagccgggtgtggtggtgggcacctgtaatcccagctgcttggtaggctgaggcaggagaatcgcttgaacccaggaggtggaggttgcagtgagctgagattgtgccattgcgctccagcctgggcaacgagagcgaaactccgtctc

SEQ ID NO: 346 - DNA, 3107 bp, Homo sapiens
ctgaggattcaacattcacattttattatgtttagctgtgtgactcctcgcttctgttttcagagtctgctccctttcctgcttttgagctctgacagtacacctcgagttttgaagtataatttatgtatcatttccaagctcctgaaaggggactggggagcggaaggatctctgccgttggccctgtctgccaccttcagcttgcacagggcaggtgtcagcaactcgagggggtgtttgtggcttgtgattcttcatctgcccctcacacagaacaggcacctcacttctactctagagctcatgcaaatgagagcacacagcacggggggaggggttaggggatggtgtatagtgtagagctacacctgaacagggagcaggtgagggctccagccgctttgtctaccaggacaagtgggccaactgtacaacaccctgagcagaagcacgccagagccccatccaacctcggcccacttgtcctggacggtgcccacatagggtgtggaaacctggagaacccagcgcacagctgtggctccccacacaggctcttctcactcccagatccctaaccattggcgctgagggctccctgaagagaatggctgctgcagatgtgtgatgtgctgacagacattcccctgatgctctcaagtggttgagtgggcaccagcatccctttcctggcagcagcaaagctgagtagccagtggtgcaggtgacactaggcaagaacatggggaagacgtggctcagaggcatgtgcctgtgatgtggtcctcgacggtcaggcagcagatccaagagagacagaaataagctgtcttgaggctcatagaccccgtgttcccctgcgtgtctcgggctctgtacacagttgggggtttgcagaggatgttcctgtttgggttccccccagggcgttgttcagattggcagcctggggcaggtgccagagactgaagcatgggtcctggctcagtgatgtgtcctctgggccaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcagagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcagggcggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaacagt

SEQ ID NO: 347 - DNA, 2955 bp, Homo sapiens
atgactgttttctgcctcctgggtctcaaaggcaggtgcaatgcccagaggctggtcctgcacagagggacccagggcgtgctggccttcccagtgtcccactggtggctgatctaagcagtgctttccctcgttttttttattttgagacagaatcttgctctgtcccccaggctggagagcaacggcacgatctcggctcactgcagcctcccgcttcggcctcccagatagctgggattacaggcatgtgccctcatgcctggctaatttttgtatttttagtagagacggggtttcaccttgttggtcaggctggtctccagttcctggcctcaagtgatccgcccgcctcggcctcccaaagtgctgggacgacaggcgtaagcctctgcgcccggcctcctcattgtttctaatggtccctcagtgcccaccgggtgatggtggcagattttccatccgcattgctcccggacatgcggacgtaggtttcagcagttcccatcattagacacagttgccgtaggctgggttcttagtagcaggctcagtggggcctttgagtctttccatggctggtgcccgccggactcactgagggaaactaatggggaagcactggtctccattccctgcacgcacagcccactgctgcgatggtgaagggataaggttgtgttcacgcgtcgaagtttgtgtccactgcacacgcggctcactgctgcgatggtggagggataaggtcgtattcacgcgttgaagttggtgcctctcagtatcgctttatgtttgttggccacttggtggtccttgtatgagctgtccactccttgttgattggccagagctctttacatggggaggaccatgggccggaccatgggccctcatccagcaggtgtgcaggcacccacgcactctcttgtcccttgcagcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcacccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccaccccacccctcccccgccgtgtgtggcccctcgccgcatcgttggggttttgttacgtgaaaatatcctggaaataaatacatgtttctgc

SEQ ID NO: 348 - DNA, 2945 bp, Homo sapiens
tcatatggttctggaggcagggaagtccaagagcatggtgctggcatctggtggggtctttgctgcattaacccaaggcagaaagcaaggggcacaagaaagcatgtgcaagagagcttgcttttataacaaaggcacttcaccaataacccactcacatgattatggcattaatccatttatgagggcagaatcctcatgacccgtttgctccctgcaaaggcctcatcaacaccaccacagtgggatctaagtttccaacatgtgaacttttgagggacataatcaaaccacagcacaagtatattagtttcctgtggctgttttaacaaataaccacaaacttggtggcttaaaacaacagaaatgtattctctcttagttctggaggccagaagtccaaaatcaaagtgttggcaagaccatacattctctgaagcctctaggggaggatacttccttatctcttccagccactggtggcattccttggcttgtgactgtatcagactgtatcattccaacttcttcttccctctttatatggcctcctttgtgtcatctcttttgtctaaggatacatgttactatatttagacccacccaggtaattcatgatgaactcaaaatccttcacttaattatagcttcaaaggcccttttccaaataaggtcacattcacagttctgggggtgaggaaatggttctggagccaccgttcaaactgctgtatctttgtacaaaagacaggggacatcagaccattgaccaggcacagcaggtgagtccagagataactctcccaagtccatcccccagaacaaacatggtagacaggtaaatgtgaactgaacatctcatgcacaaatgccccaatcgtgttactataacctcagtccatcatttgtttgaacgcaacatcatagtatttttatttcccagccagaaaaatgtatgattttttttagatgagatcagatatttccttaatattttctagagcacctataccgatggaatcagaggtcctgacagtgatagagaaagagctctcttccctgtgtcccgggagcagtgccagatggggaaacaggaggcccaggtgcctcttgtcctagcctccaaaagctcatgacagcttagatggtaggaacagaaaaatgggaacaaaagatgacatgatgaccaaagccagacagttgggatggactcaagaatttgacctcccaaagccaggcatgtcactgttgttttgaagcaagctgccttttaaaaaagtgacttgattgccaggcattgttgactacacacccatttctaaaggatggtgatttacaaatcgcctgaagatagtctttcaaatttggacatttaaaaaagaaacttttactgtagtcatgaagtagtatcaaagtttaccacaagtttgtattgagagaagaacaaacaatatatgctaatatgaaaaacagctctacttagaaagctactgcttgggttttcttattaggcatagttctccagactgagttggttttactcatctacatgatttttccttgccttatggaacagaaattcaggcccactcgaattcagttattttagggctctttaaaatccagtatttgtgatttaaatgatgcggagggactttcattacctgtgtctttgcttatttctctctggccctcagaacaccccaccctgacctttaggggaaattgacagaggcagaggatttcacctgcctcaattgtcaccagccctgttacattcttccttccaagccttagcctcacagggaccctctcattattgaacaattgccttcaaagcagtagaatagcccaattgttatggagattaaagatactgattgcaaaactcctgtaaataaaatcttcactgacaaacccagtttcttttcataggcttttcttctgtaatctctttctggcagaacatctcatgttttgatgttagagattcagttaccaaccacagtaaataaagcaaaataataatagaaaaatagtatagaactcaccctaaaaacaaacattggccaaccatgtttattttttgtctctctttgcactcctgagaattgataggggaagaatgtaccacctctaattcaggtgatttctgattagcaagctatggaaagtcttcaggttgagttttagccagttcacgctcccctaaatggcatggaatagactattttctgttttaagaaaaaatagaacaatggcactaaatgcttgactgaatgtttgactaaatgttgactgaatcatggataggaaagattgggcagaaaagacagccactgcctccagacacaggatgccacaatcctgggcaccatcattattccatacaaccttagggtcatttttagggtttagaactttctcaatagggtttcaagattttgaaaagtgtcttccaattctgatctccgtagatcctgttatgggaattaacctttttggaaggggattcttgttcttaaagatgaaattccctactttctttcctggagggaatcagtatgggcagagggaagaggagatggcgattctgacctgtgtgtctcatgtcacctaacacctatggggtggcatgaaacttgagctttaaaacacaccaggggccaggcacagtggctcatgctggtaatcccagcactttgggagaccgaggtgggtggatcacctgaggtcaggagttcgagaccagcctgccaacatggcaaaaccccgtctctactaaaaatacaaaaatcagctgggtgtggcggcgggcacctgtaatcccagctacttgggaggctgaggcaggagaatcgcttgaacctgggaggcagaggttgcagtgagccgagatcaggccattgtactctagcctgggtgacaagagtgaaactccattt

SEQ ID NO: 349 - DNA, 2648 bp, Homo sapiens
cggtgggagcctcctgggagaggcggcctcgcgggactcccggaccctggctagtccgcggccgcggtcgggcccagcgcccgccccaagtgccagcagtgccggaagcggagcgttttcctggtccggccgccgggaatggcgctcctcccgggtgaagaatgcaccactaccagtcgggacgcactcgtgcacttagcacacatttacgctcgcctgccgcgggccgctctccgtgctgggcctgggaagagagtcagccacgccgaggacagtcccgggggccggggttaaccgagtggacgcagctgcgggggagcccgtcggcgcgcgtcctgccagtcgtagggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgagcctgggagtcccagccacagtgctccagaccctgatggacttccccatttcatggagactcctcttcagcccccacctccagtgcagcgagttatggacccagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccagtgtcaagtctgctggaatgcaggaagtagaacagaatcgccacaggaccgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaat

SEQ ID NO: 350 - DNA, 3033 bp, Homo sapiens
agcagtccccgggcttgcgcggcgcggagagggaggcgccccgcggcggggcccccactcggtcagcccgcgcgtcggtccccgcgcggccgccatgacctggagcgccacggcccggggcgcccaccagcccgacaacaccgccttcactcagcagcgcctccccgcctggcagccgctgctgtcggccagcatcgcgctgccgctcttcttctgcgcgggcctggccttcatcggcctgggcctgggcctctactactcctccaacggcatcaaggagctggagtacgactatacaggcgacccgggcaccggcaactgctcggtgtgcgccgcggctggccagggccgggcgctgccgcccccctgctcgtgcgcctggtacttctcgctgcccgagctcttccagggcccagtgtacctctactacgagctgaccaacttctaccagaacaaccggcgctacggcgtgtcccgcgacgacgcgcagctgagcggactccccagcgcgctgcgccaccctgtcaacgagtgcgccccctaccagcgcagcgcggccggcctgcccatcgcgccctgcggcgccatcgccaacagcctcttcaacgactccttctcgctttggcaccagcgccagcccggcgggccctacgtcgaggtgccgctcgaccgctccggcatcgcctggtggaccgactaccacgtcaagttccgcaacccgccgctggtcaacggcagcctggcgttggccttccagggcacggcgcccccgcccaactggcgccggccagtctacgagctcagccccgaccccaacaacaccggcttcatcaatcaggacttcgtggtgtggatgcgcacggcggcgctgcccacgttccgcaaactgtacgcgcgcatccgccagggcaactactcggccgggctgccgcggggcgcctaccgcgtcaacatcacctacaactacccggtgcgcgcgttcggcggccacaagctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatcttattgattaacatcaatcagtatgtttaaagttattctaagaagcaatagtttatttttaaaaaccttgtacagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaatttaaaaatt

SEQ ID NO: 351 - DNA, 3949 bp, Homo sapiens
gttgtttgaaaagcgaatggactgaacaagagcagcctttttaaagcagaagaccttttcttcaaatgaaatctgataaaggcattcattaagaaaactgtggctagactattttgaaaataagagtttctaacctttccttattctgacccaacccggcgcatgacattccctgtctttggggtgcggtgaggacgtgggagctgagagctggggctttgtggtctctgcggctcccccatctcctgatgccctttggagctcagaagtccaggcattttgatgtccagtaatgggctggctgttccgtagacagtgggctttggaattccacagcattgccctgacagatgggaaaggaatcctcctctgcaaacagaacccagggacatggacttgctgttgacccacatcaatgtcgtagaaaacttcccttgtgagtatttgacaaactcagaaacaatttaatattagaaggagaggaaaaaattgctcgcagagtttttgacagagagggagctcacttgcttgggttgagcgttgctccgctgggagagggatggacgctgctgcagcctcttcagctacatttaaaaatggcgctgggcacatcccttctgcgctttggttccttctttcccataactgatgcactgaagaattttgcatagctttcttatgtcccagtaagagtaggaaatcaatttaaaaaggccaggcaccgtggctcacgcctgtaatcccatcactttgggaggccgaggtgggcggattgcctgaggttagaagttcgagaccagcctggccaacatggtgaaaccccaactctactaaaaatacaaaaaaattagctgggcatggtggcgtgcgcctgtaatcccatgtactcaggaggctgaggcaggggaattgcttgaacctgggaggcggaagttgcagtgagccgagattgcaccactgcactccaggctgggtgacagagcaagactccatctcaaacaaaaaacacaaaacaacaacaacaaaaaaagaaggggctggtttgaattaatgaaaaatctagaaaactcatggttttattttgttaaagactgtaactcaagccagatagtcacattgtctcttcttccttagggatcttatttgacaaatatatagaaatgttagtaattagcatatcaattggcagtctgttaattcatggttgtaataaagccttgctgttttctggagtgagctaggccagtttacttcatgaacagacttaacaagcctcatgctagccagttctgagctccctgaattggaagcaggtgtgatgcgcatgcgtggtgctctgcagtctctcagcttccccagcggccttggccccttctcctctgatacttccccttttatgcgtccgcagcccttttgggttctgagctgcggcaagctttaagcaagtgttttaattttctttagttcacttagctaagtcttcaacagattaactaacgttcgtaccttggtagaattatagccagattttgcaaagagcttgtgaaatgacagccagatggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggtaaccgggtggaataatgcttgctttgctggcattttggccttaattttagaaaacaacaagttaggtttgtagggctcaggacaggtcaaaactcagtgcactaaatgccaccacagcccagagttctgagtgacagttccaagcacgtgctgatgatcaaagccctagagaaaccaaagaatttgaatgtccctttgaaatttacagcaaaaaatttaccctatgtcttcaagacaaacatgagaagcaccgatttatgaggtgccaggcacactagtgtttatgaatacttagatgatttgtggcaaatagaaaggccataggcttcagaatagacctggattcaaatcccagcattgccaattagcacctgtgcagccctgagcagctcacttaacctctccgagcctcagctgcccgtctgcaaaaaagtggattcctatcctgcaggtggtagtagggattaaagaaggtaacttgtgggcagcacctgtgtgcttggcgctcggtaaatactggacacgtggcacacgttgttaccagccactggggcacattggccttggtgacctaatggagaaagccaaaccgaagtgctaaccccacaggtcgatggaggccccgagaacttgttggttcttccacactgaaggaaaagctcatggaattttaagggcagaagagaccttggcggtgggaggtgttagagcttcctccatgcagacacacacggtgggccctggggcgaccccacccctgcccgaagccccagggtcccttgtggtctcgtctggatgtggggtggtgacgctctgctgtccctttggagggtacgcgtgttgggggcatgggtgggagcagagccacctccaaagaaacccccccttggccatgtgctttcctcccatggagcacaggtggggggcccagcctgggctcctcattgccccccgagacccagcacgtcacctccacatttatagactctctagctggacccagccatggagccccagaggctgggggctgagcttgtgcagccccaggaacctcagctctccagggctcctctggcccgagggaggggctgacagccctttttgttaagggcattgacagtgacttctgggcaggagaccctaatacgcttggagtaaaaagggagggtgatgccttggtgggcccgaggctcctgggagcccccggctgcagagacaagaaccatgaggaaatgcagagtgaggcccttggctagccagggcatgggacccggtccctgcctgtgtgtgactgcaaaggccactcaggcacccgctgcagcagccacgtggggacactgaccagaccacacagcaccagcctgtcccagccagtcccagctccaggctcaccgtatgtccccagccgtcaccagctccaggctcacagtatgtccccagctgtcatcagctccaggctcacagtgcaccgtccggttccagccgtcaccaggtccaggctcacagtatgtccccagctgtcaccagctgcaggctcacagtgcaatgtctggttccagccgtcaccagctccaggctcacagtatgtctccagcagccaccagctccaggctcacagtatgtccccagccgtcaccagctccaggctcacagtgcaccgtccggttccagctgtcatcagctccaggctcacagtatgtccccagccgtcaccaactccaggctcacagtgtgtccctcaggacccgggactcggcgctagacccccagagtgagcatgctccagcgtaaggctccaggcctttccctctcggaagggccaccctttagaagtgcctgctctcatctgtcctggaggttatggctgaacccacaccaggaccgtcactcattcgagctccctgggtttgctccaaggctgtgctgttgagaccacatccaggacaggagtccggtgctgggccagggtcagatgttctgatttgcagggaggagccacttgcatgcatttctctgtggaaacaaaaggcttgtttttgaaggcagcaaccctaaggatgtttaaaaggcaagtggacagttttgggggtaaacctatttaatgaaatgcacacagccaatattgctgtcacttgtgtcttcaggtgcctagagggtgaatgtgatatatagcaactcaatatcttagtgcatttaaatatacatttt

SEQ ID NO: 352 - DNA, 3657 bp, Homo sapiens
atctctgttgacctctcgtctttcttcatcacttaaccgattacataaagatatcatagacacctttcatctccctctctcaaagggtaattgattatagatacaaaatgcagttgaattttactattggagttagagatcatctaatttaatcccttattactttacagataagaaagctgatatacagaaaagttaaatgattttcttatggtcacacagctatgagtagcagagatagggctgcaatccaggtctcctaatttctaggccattgttgttatcactatatgatacggtttggctgtgtctccacccagatctcatcttgaattcccatgtgttgtggaagggacccagcgggaggtaactgaatcatgggggcaggtttttatttgtttttgttttgttttgttttgttttttgagacagagtctcactctgtcgcccaggctggagtgcagtggcgcggtctcagctcactgcaagctctacctcccgggttcacgccattctcctgcctcagcctcccgagtagctgggactacaggcgcccaccaccacgcccggctgatttttttgtatttttagtagaagtggggtttcaccatgttagccaggatggtctcgatctcctgacctcgtgatccgcctgccttggcctcccaaagtgctgggattataggtgtgagccactgtgcctggcccatgggggcaggtttttccagtgctgttcttgtcatagtgaataagtctcatgagatctgatagttctataagggggagttttgctgcacaagctctctctttggctgccaccatccatttaagatgtgacttgctcctccttgccttccaccatgattgtgaggcctccccagccatgtggaactgtaagtccattaaaccctttttcctgtataaattaccaagtcttgggtatgtctttatcagtagtgtgaaaatggactaatacactatattagactgacagagtaggccttgcttgaatgacgggtctctgagggccctatagatatgtgagtatgtataatgggatgttgggggaaatgtgtgcaaatgttccacttactgtagttactccagcatttgaccaactgtcttgtatgttttcttctacgctattctgctctggttttctgttttttctttctcacactatctttagcctaatggcattgagtgccctctggaagtgagggttggtgtaaatagcgttcatatatctagttccagtgacttggctataaagttcaggttgaaataggggacagtgaaaaaggaggtgatatactccatctgtttgtttagtcttgtttagggacttctgataagtgcatactctggacacagaacatctagggattattctagccaccatgatctcaggttctgggctcaggaaatggacaatcattggatcagtgtggaaaggatagtgtacaacaggattgagttgggacaagatttgggttatatcataagggccatctctaagacctgccagagaaatcagattgttctttattatcttttatgtgcctcctctggagtataacctgaatgggaattttactttttgtcactgacatacccaatttgagagaaggtcatgatgtttgggtggagagctgaacctagttaaggctaatggggaaggtgaaaacaggggttatgagtacctgtcctgtaaaaggaagaaatgggcaattcaagccttgaggctcttggtgtcctgagttttgttcaggccctacctaaatctgtcacgagacttgagtgtaaatgcatgatgaattgacagcctgagcagtgaagaatgtcagttcaacagctatcagtctatttctacaccatggctatgagaaaaccaagaactgatcagagtggagttaatagtaatagaaagttccagggtagagtggtgagagtgcttatgacctataatgatagcatcatctccatcttcatctctctccctggtggacacacacaggcacgtatgtccacacatgggtagacatttttatccctaactgtggtaagattgggcctatgataaagctgagtacagagacttaacgtcctatcctcaaaccaaaaagagtgaggagtgggagcacacaagcacattttcatatctaaataagaaaagtccaagttgagtctataaatgttataaacgggtaaggaaggtagagagtttatggatttagataatgtggaaactagaaggaatgggcacttctttctcaagcctgggaagactgtttgaagtaggattcttcaagttagttgccattgtgatttcctgtacaaaattattcatcacttaactgctgatgcttttctcttgaatgactggtcagatttttaatgtaactttgagactagagcaaatctgacttgttctgcttgcttcctttccattcattttactcatccaggcacttgacaccaaggtattgatgtcccactctcctgggcccctcattcctggctgatttcatgtgctgctcccctatcttagaaccctgcagtggttccctaatgttctgaggatagactttagttgccttaacatggcctgcaaagccggcttgatctgatcctagcttgcctcttctacatcatttctcaccactcctctgcaattcactattctctatgcaactaacacacactaccttatctttccttcaggccttctgtatcctattacttcttcccagacacttccccgctgtttatttaattaactcttcctaatcctgcagttctcagtctagctgtcaccacatgacttctttaaactcttaggctaggctagttgccctcctctaggctcacaccatgctctataatctgcatcacaaccccttaccatgctgtgttgttaattacttgttcttgcttgtaatttccagcagactaaattctgtgggggaaaataatcttctttgttttattctctgctgttttgatgagcatctagctcagtgctgggacatagtaggcactttcgtaaatttttgataaatgaagtgggtgtattgttctgtgacaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgt

SEQ ID NO: 353 - DNA, 2980 bp, Homo sapiens
aggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctg

SEQ ID NO: 354 - DNA, 2785 bp, Homo sapiens
ataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtggatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatac

SEQ ID NO: 355 - DNA, 2522 bp, Homo sapiens
atctacctgggctcagatactgactggcacagaagataccgaactggcccgggattcccgagtcacgttgttgggcatcgagagggtgcagcaggacacgccgacagtggcctcgggtagctcgtcgtcctccgtccactcgttgagctcggggctgaagcactggatgcacttcttgtacttcttctcgccctcgttccagccccccaccaggtaggcgcggccatgcagcgccgagacgcccgcagtgctcactcccacctgcagcggcgccgcgtagctccactggccggtcgcggggctgtagcactccacggtgagcacgtccacgcgctccccgcgcggccccagctggctgccgcccatcacgtacactctgtcgctcagcgtgaccgcgcagtgccagccccggggtgtgctgaggttcggcagctcctgccacgagtcgctggccgggtcgtaggcgcacacagagcgcgagtaggcgttggcgatgtagcctccggtcaccagcacgcggccgtcggcgaccgcgctagcgtggcagcagcgcgccacctccaggggcgtcttcggctgccactgattggtggagggcacgtagcactccagcgaggccaggcttccttctgcgttgcggccgcccgcggcgtacacgagcccgttgaacacgctcaggctgaagtgcgtgcgcttctggttcatgctggccaggtgtatccaggtgttgaagcggggatcgtatctggaaatgatagagaaggtgtaacagctttgtcggcggcagctggggaccccatgttactttgcaaatcatgagtgggaagccggacactacccctgcaaggaggcgagggacctggcccagcacctcacctggaggctggagtttctctctcagccagtaaaaatgtgtgacacttggaaaagacaaagcaggcattgaccacccctcgcccccgtttataagcctctcctccgtttataagcactccctttatggggccacttggagaagagcccacagagactgagctttcagtccccctttcctccatattcaaatatctatcatccagtgggatttacgagatgtgcacatgggggaggctgggcatttgtgacgatcagaggagtggcgatcagagaagggcatcgccatattaaagtcaattctgcatatcctcagatgccaaccattcctagctccctgtcacagtttaagatacgaattgactgactggatttctccatttctcacaaaccccttaatcctacacctctcttggccattgcgacagtaaagccaagccactcagcaaagtcttctcttgtctgttagactgagaccaatagaactgtctaaaagcatcaacaaaggcttaactttggatactcttctattttccagcacttgtcagtagagaagactttttagtttagggataaatatatatattttttcagtgctcggaactatccatgtataagcactgcaatcaatacctcacaaagcgactcgagtactaaaaggtgtctttacagcaggaggaaaataagcatagtgaactgatgctttcctgttgacatagttcagaagtattgtaaatacagaactcactccttcagtctgatgttcatctttgtcccatttaactcccaaattaaactcaactatagttacaaattaaacactaaaaatcagttaattgtgttctttaaaatgcatacacacataatggaataataaagaatatttttcatgaaatactacacaaattttcagatcttgctcattagttatgtttgactttatactactaccatgatataagcatgattttctgaacatttcatatgaatggaagtttaatttttaatcataaatatataaaataatatggcatttgaattccatttttctgaaggatgtgttttactcttttactcttttctgtatgtatcaaaaatactgacacattttctgttattcggttttcaaataagtatttcaaattaattagctgccacatttttaatgatctcattctatttgccaattatgaatttgacagttgtcagtagcagtcacttaaaatacattttgtattattctattctttcttactacttagtgttaaaaactgaatttgtatctaatttctatcaaaagtcagtgtattgtgaagagtacccaactagaagtgagtaaatgtgaattgccgcttactggtgttataacttctctgggtatcaggtttctcatatgtaaaatcagaataattatatcttccccgcccacctcacaggcttgtttcagaaatctatagtgcaaaatataaatgaatgtactttatataatataaagtgctgaacatacgtaaggtggcattattattatttttgatttactaagccaatggactaagttaataagcaagattaatttacttctatgttagggctatttccctataatattgagccatttcagttcctaataaaagatcaagtacctgcag

SEQ ID NO: 356 - DNA, 2732 bp, Homo sapiens
atatcctgcctgagcctgggccgggtggaggtgtcctgcatggagtcttgtgaaatcgcgtggactgcaacacccagcagcgcgccgccctgggtcctgccactgagcagctgttggtaggctctgctgtgaggtctcctcttccggctttcccacttcccaagtgttggttaaggaatccagatgttactgcaataaccactccataaacaaaaggaacacccagctgtgagaactggcttctcagcattcgtcccagcagaggctcttccggggccagccctggaagaacccatcagggttctgatggttgccctgtttcagcacagcccttattggcaggcagacggctacgggcacagccacaggctgaagtgtcaacacttcaaacaacacagacagtacaatgacaaattggagatcagctctaatctcggcccccaatttaatgcattgctgaatattcttctgaacatagtccatcccacactgtcccatgacacaagacgctccaaggggctgaagatagagggacttctgcagtcaagagagctgggaaactcttggacagtcacaatgtgcatttgggtattaaaggctctgcaaagttctgcaccaaataaacccttggattggcttgatccaatgccatgtttccaaaacctacttgcccgtgggacaccttagtccataacacaggttggcatttcttctagagagtgtgctgtgaaaaacactggtctcacagcaccgtgcattcatccagcaggtatttaccaagcagggactttgggccaggtccgtgctaggctctgcaggtggaccagccagccctgacctccatggtgtctcttctcatgggagaggctgcacagcagtcattgagaaaacgaagaaacacacaggtactttcagatgctgataatgactaccatgtgctaaaagagctccaggtgttgtctgttttgagacaatcttctcgacaatgagatagaatgaaccatgcaaactttgggggctacgatggttttaggaaagagctagagtgaaaaatcctttgacatatatacatacaaataaagatacatgtgtataattttatgtaattgacatcacattatatgctggcacctgccttttttgcttaatgaaaatgtcaaaggtaatattaccaatcaatcaatatatttcaccatcgtgtttaatttctgcagagcacttattcaagcacatactgcatttttcttagtcactcactggtgggaatagaaagttttctcaggcatgcatttttcccacttctgaaatgatctccttagaataaattccccaaattgtattgctgggttcaaaggcatgaacattttacatttttatacaataatgtcaaactaccttccggaaatgatgctcactttactttccctccaagactgtgtgaaaatgcccattttcctaaatgcttactatgactggtttccaactacattttaattcttgttcaatctgataggcaaaaaatgatatttaatttttatttgattgataatgaccttgaacgtgcccattagccttttgcatgtattcttttatgaaacatctgttcctatccttcgtcaatgttcctcttcatatgttaacttttcttattgatttgttagagcactttgtatattgtgaatattagcttttgtgatcagaattatggaattgttgttgtctttagttttgcttatcaagtttaaagccattcagagatgttgtaaatgtgtatgttgttaaatttatgtcttattttgtgttttctgatgctcatatgtttagaatggtcaagcaatcccaacttatgattacttaaatattctcccatatttgctcttagcattttttttcttttcatgtaaccctttgttctttcaggaatttactttgcggtaagaaatgggctggcttccagttttatgtttcccaaatggtgattcagctgttccatttccatattctcccttattagaaatgaccactatattatgttctaaaatatctgcgtacttgtgtcccttcctataatctcagttcatctctttgagctatcttttgattcctttttcaaaccacactgctttactgaactgtcatcatcttatacatttttaatactcagcaagacaagtttctcaatgccactctttttcagagtttttctggtggttgtaagatgtttattcttctggataaactttagaatcactctttttgtccaaggtaaaatatatcccacattgagatcatactgaatatacagactaattcaggaaaaaatgtatgtctttattgcattgagtcttcttatccaataaaaaagatatgaatttccatgtattgaaatcttcactgagacttatttttggcttttcacatgtcctgcaaatgtattgttaaatttatttttaggtattttaggggaaatgattttctaaagtttgtattttctagcttgttataatttacatatgagatagtcattgttgtatattatttataactgatcatattactgtatttgtattgttttaatagtttttctattattttgggttttcctggaatacaaccttattatctacaaattatgattgttttgccttttccaatgttcataactgtttttatattcttgtctgattgctttgttcagcacttctagaataaagtcatgcaatactaatgat

SEQ ID NO: 357 - DNA, 3609 bp, Homo sapiens
atatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttagtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaacaaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccat

SEQ ID NO: 358 - DNA, 4064 bp, Homo sapiens
aaaaaaaagaggccagcctgcggggactggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcggaagagttggatgaacgtgggcataccttatataccagtgactatactaatgaaaagtggctcaagcatgttgatgatcaaggtagacaatattactacagtgcagacggatctcggtcagagtgggaattgccaaagtataatgcttcatcccagcagcaaagagaaataattaaaagtaggagcctggacaggcggctgcaagaaccaatagtattaacaaagtggagacatagcaccattgtattggacactaatgataaggatcaagagaaatatggattattaaatgtaacaaaaattgctgaaaatggaaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgccaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatggtgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttgtagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggtagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatggtccgttatttgggaaagttaactgtgtgcacttttagatattaactacatctacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattgg

SEQ ID NO: 359 - DNA, 2504 bp, Homo sapiens
atagagcaaaaaatgacataaaaaaaactaatgagtaaaagtacacagaggtcaaaaaactatgggctgggggccaaatgcagcccaccacctcctgtttttgttttcctggaactcagccccactcatgttttctccatggctccttttgagctacagtggccaggccgggtacctgcaacagggaccagacattacaaatgtctgctgacccctgctaccagatactacacaacagacaaaagcaagagttattgggggcttcagtctcctgagcactgaaatgaagacaatattccctcttttcttcagcggtacacagttcaattttttttttttttttttttgagatggactctcgctctgtcacccaggctggagtgcagtggtgcagtcttggctcactgcggcctccacctcccgggttcaagcgattctcctgcctcagcctcccaggtggctggaactacaggcatgcaccaccatgcctggctaatttttgtatttttagtggagacggagttttgccatgttggccaggctggtctcaactgatccacctgcctcagcctcccacagtgttgggattataggcgtaagctgccgtacccggcccacagggttcaattagataaacaatatgagtgcaagaacttttgtgtaggaaggaatgtcctcagcctactcctcagcttcagcttcacaactaccctcttcaggttcaattaccagaagctaacttcctacaagagaaaaagggcaggcccttctatgacagcacggaaagacctcaagccacgtttctcccaccagtaacatcttgcaaagctacaatatcacagcaaggtgagtgatgctgacacaatccacaatcttattcagatatctcgggttttacatatatgcgagtgtgtatgagagtgtgtgtgtgatcacacgtaggttcatgcatccaccaccacagtcaagatacagaacagtctgatcaccacagggatcccctggtttgaccttttataaccacatctacctcccttgttcctccttgccaacccctggcaaccacaaatctttgccattcaaggatgttatacacacagaatcattcagtgtgacctctggagattggttttcgtcaccaacaaagccccctggaggtccacctgggctgtttagcaagagtctgttcctttttggtgctgagcagagttctgtggtatgaatgcacagtctgtctgacccgctggaggtcaccgtggaaagacatgtgggtggtttccagtttttagctgttacaaaaagggctgctgtgaacatttctgtacaggttttttggtgagtgtcagtcttcatttctctgggataaatgcccaggagcacaagtacagggtaattgcgtgtttagtgtgtaggaaccttccaaactgttttccggagtgactgtgtcattttccatccccatcagcaacagatgagagatccagtttctctgcacctccatttggtgttgtttcagtgtctttattttagcccttctgctagttaagtaatgtctgctttagctgcttacaacactacatttacatatcaggttaaaagattaaagtaaaattaaaaagtaatccatacttattttgtggaaaactgaaaaatacagaaatacatagaaaggaaataaagtcctgtttcttctcttaggaaaaaacccgccacactgctgtttatacctaaatcaacgtacccaactggcagacagcacgaggcaggtgccactgctttcttctcaccccagggctccacttggaactctcctcaccaggatgacaactctgccctgggcctctgctaacatccctgtggccctttgcgtcagagcctcacctgaggctttaccagacatcctcagttctcctcaaaacagacagctgcagccccagttaaagaaagcactgagggctctctcccaaatgtgagccacagacatgtcaacgggacagggcaagtgggtcccagggctccaggcagcggtgcatgcacatgtggggaggagcgccagctcgctccagaacaggtttcctcactgcttattgtcctgtaaaggctttggcagcctagtaaagcctatgggcctctctcagaataacttttttttttttttttttatgagatggagtctcgctctgtcgcccaggctagaatgcagtggtgcaatcttggctcactgcaatctctgcctcccaggttcaagtgattctcctacctcagcctcccaagtagttgggactacagacgcctgccaccacgcctgcttaatttttttgtattttcagtagaggtggggtttgaccatgttagccaggatggtctcaatctcctgacctcataatccacccgcctcggcctcccaaagtgctgggtttacaggcgtgagccaccacacccggcccaggataacattttaaaatgtgtaatataaaatacaggtggcagaaatgtaaaatacc

SEQ ID NO: 360 - DNA, 3498 bp, Homo sapiens
acaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattgcaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatcttacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctgtaatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggccttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcgacctcgttaagcatccctgtgacgctctcaacttcattttaagggtgccaagagactggttagtcaaagcctctagaaggggatcctcgttgaaaggagccctttttactcaaaacacatgggctagtacttgaggtgttcactgattgagaaaatacccgtgaggtatgggactctgat

SEQ ID NO: 361 - DNA, 2428 bp, Homo sapiens
agggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcgtttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttccccaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgtaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaat

SEQ ID NO: 362 - DNA, 3088 bp, Homo sapiens
actgcaacagctgcctctcgggttcaagcgattctcctgcctcagcatcccaagtagctgggactacaggcgcccgtcatcacacccggctaatttttgtatttttggtagagatggggtttcactatgttggtcaggctggtctcgaactcctgacctcaggtggtccttccgcctcggcctcccaaagtgctgggattacaggcgtgagccactgcgcctggcctgtatcagttatagtttttgcaaaggcagtttcaggaataagaagcagaaccaggactgcagcccaagccaccacgagaggccagtctttggggatggtcttttaggatgatctttgggggtggcccaaggagccccaggcagctccagaggcaggagtcactcaggatttattgagagcccaccctgtgccacccgctgtgcacagaacacccagagatccctgtccagacagacaagttcttcccatcgtatgttggcgtgataactgtgatggagaaagagaggaagagccagcagtgcctccggctggggaggcggggcagacctcacccaggtggtgacatttgagccccagctggaggggtgccagggcaagagtgcccaggaagagggaagagccagtccacaggcctggagacagaaggctgactgaagaagagtctggaggctcgggtggctgcagcagagaaagcaagggggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggtgagacatttttcttccttctgtcacatcacacccaatgggccctgcagttctgcgtggccagctggcagcagggcctgctctggatcccggcgacgacattatgagttgaagaaagaagagtaaagctctcggagagacttgcttcctgggcctggcacgagggccctcactcatagcaccctcttgtcaccacaggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacgtgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacctctttttttttttttttttttttttgagatggagtctttctctgtcacccaggctggagtgcagtggcgtgatctcggctcactgcaacctccgcctttccaccttccgggttcaggcaactctcctgcctcagcctcccaagtggctgggactgtaggcgcccgccaccacacccagctggatttttgtatttttggtagagacagggtttcgccatgtcggccaggatggtcttgatctcctgactttgtgatccgcccgcgtcggcctctcaaagtgctgggattacaggcgtgagccaccgcgcccggctgccttcacctcttaaggagctctgagactccacttctgagagtccctgcggcctcccacctccctgcctttcaaagctctctcccccatgacccaggataaccctatgtctcctcccccagaatccttcagtggctctcatcaccttcaggaaaagcccaaactccttccaccctccaggttcctccctccccacgaggctttgttctcctggggttgcttcctggaccctgaacaagttgtgctctcattggccgggcctggccagcagtgcacagtgcctggcaggttgactctaccatccccggggctggccccgctctcctccgagacccaggctgagcccagtcccctcacccttccttgacttacctccccacctgaggctgactttggggttcccagacaccctacccacacacatgccttgatcatagcacttgcctgcgcttcttcagagtcattaatttgcttctcggcttccccactggactgtgagctgcctgaggtcagggattgcgctttggatggtttccagcctgagcctggtgcttgaacagacgtgtgcaataaatgctcgttaaatg

SEQ ID NO: 363 - DNA, 3404 bp, Homo sapiens
ttttttaaaatgcttcttaaaattcactaaattgggctaggtgtggctcatgcctgtaatcccagcactatgggaggctgaggtgagaggatcacttgagcccagaaggttgagaccagcctgggcaacatggtgagaccccatctctacaaaaagttttaaaaccaggtatggtggtgccctcctgtggtcccagctactcgggagtctggggtgggaggatcgcctgagcccaggagactgaggctgcagtggggtgtgattgcactattgctctctagcctggaaaacagagtgagaccctatctcaaaaaaaaaaaaaaaaaaaaaggaaagagtgatgacaacagcccagggagcagccccgctcaaaacccaagtcccaagttccagcactgtgttcccaggcaggctgtttgcctcttcctggtctggaagcccttgggtcctatggtggcggcagctcccacaggccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagaaggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaacccttttaagaacatttttaaaatgtctttttctatgtcaaatgtaacgtttatttttttaaacaataaaattgatttgcc

SEQ ID NO: 364 - DNA, 2960 bp, Homo sapiens
actgcaagctctgcctcccgggttcacgccattctcctgtgtcagcctcctgagtagctgggactacaggcgcccgccaccatgcccggctaattttttttgtatttttagtagagacggggtttcaccatgttagccaggatagtttcaatttccggacctcgtgatccgcccgcctcggcctcccaaagtgctgggattataggcgtgagccaccgcgcccagcccctttcatttttgatatggagttttgttcttgttgcccaggctggaatgcaatggcgcgatctcagctcactgcaacctctgcctcctgggttcaagcgattctcctggttcagcctcctgagtagctgggattacaggaatgcgccaccacacctggctacttttgtatttttagtagagatggggtttctccacgtgcatcaggctagtctcacactcccgacttcagatgatccacccgcctcggcctcccaaagtgctgggattacaggcgtgagccaccgtgcctggccaaagccttcttcactttcattttgtggctgctgttgtgaaatctgcagaacctcaggctgtttggactccatcttctaggttgaattagattacaggtaatctcatggtggaggtgtattctggatcgactcacttttgaaatgtttatgaaagaaattccttcacctcgggacttccacactggagctggcaatcagtatcaccttaatttacctatcacagtgaggcatctctgctctgaggaaaacaaaacaaaacaaaacaaaacaaaaaagaagagctaatggttctgttttgttttgttgttttagagacagggtcttgctctgtcgcccgggctggaatgcagtgacatcatcacagctcactgtagccttgatctcctgggctcaagcgatccttctgcctcagcctgagtagctgggatgggactacagatgcacgccaccacacatggctaatttttttattttttagagacgaggtcccatgtgagccacggtgccccaccttttaaagcaattaccgtaaggaagcaactgtctttagcaaatagaagatcataaacatccttctggagatcttgagatgttgactgtggtttatagggcaatgaaaatctacatacctgagtggggcagtgagacatgagtgccacctatgatccttccagtgagcaattctttctggtgccaggagcccaaaggaaactcagtcaaccagctgtagatgggcttgttccgagtttgttctagaagtcagaactgccagctctgaaagtaggtcacaagtgactggccatccctgggctgctcacaggaagtagctgcaaaggtcagggaaagtttttaatgactatacaggccagtgaatgacaggctttgaggagcttctcttcttggcatctgaaacaggcacatggaggagctgccttggagacagaatgacagctgtggcaatgtgagcctgattcctcagccccataaaatagatgcctttgcaaaaaacccatttatttttttttttctgtttttgagagggagtctcgctctgtccccccaggcggagtgcagtggcgtgatctcggctcactgcaacttctgcctcccgggttcaagcgattctcctgcctcagctcccaagtagctgagattacaggcatccgccaccacacctggccaattttgtattttagtagagacggggttttgccacattggccaggctgggaaaaagcccatttctatacagaggaatcatcttgcaggactcaaggaatgattaagaggaatctacagcattaactttagaaactcgatgcaatattcccaagaggagttaagattgggataagtaatctctgaattaatttcaaccttgagatgttgtgatcctatgaagtcaaagacatatttcttttttctttgtttgagatggagtcttgctctgtcacccaaattggagggcggtgatgtgatctcggcttactacgacctctgcctcctgggttcaagcgattctcagcttcagcctcctgagtagctgagattacaggtgcccgccaccatgcccggctaatttttgtatttttagtagagatgaggtttcactgtgttggccaggctggtcttgaattcttggccccaggtgatctgcccgcctgggcctcccaaagtgctgggattacaggagtgagcaccatgtccggtctagatacatatttctattaatacacatttgcagggattgtttgttactgaagttgacgccttgtgcttgagaatgctatttcactgacacaattgttatggtataaatgtgagagtatagttacaatctggacactattttttgcttgtcttattggcccagcaaccagcttgacactggggactatcaggctccaaataataaccaatgtctcactccaaacagacaggatactacggagccagggtcagcaaacattttctgtaaagggccagatagtaaatattttgggctttgtgggccctatggtctctgtcacaacgattcaactctgctgttgtaacaaaaaagcagtcagacaatatgtaaatgaatgggcatggctgtgttccagtaaaaccacaaaaacaggcagctagctttggtgtggggccctaagagcttggactttgaagccaggttcaaatcctggctttctcaccttctagctccgttaccttaaagaacttcattatcttccttgtattttagtcttttcatctctaaattagtgatagtacttaacagtgttgttataaagattaaacgagttaagtttgtaaagtacttaaacagtgcctaccaggtagtaagtgctatagcagagtgtgttagataatgaaacatcctgtgctgtggatatattattcccattacgatttggattcaaataaagaaatacatgactt

SEQ ID NO: 365 - DNA, 3115 bp, Homo sapiens
tttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttattttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaagcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaagctgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagaaggcaattttgatgttgcctttcttacccatctgctaaatcaagaacagctgactaatttctcagttgttcagctgctttttgaaaacatcctaattaatttgatcaataacttagctggaaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgaggtgagtatacttttgctttgtgtcatatatgcagttgcgatatatctcaaactactttattttctggagtatagacatgtcaaaaacagtatttgtatctaatacctttgaaagatctttgatgtaaatttgtcttaataaatattttatcaaaatgtc

SEQ ID NO: 366 - DNA, 2936 bp, Homo sapiens
ttttctaacttctgggactctttgcgcaactgctaggatttctcaagtgcatgtggcaacacagcccagctccgggtggaaaccagcagggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctgccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgagagctacctcctcatggcaagcacccagaatgatatggaagactgggtgaagtcaatccgccgagtcatatggggacctttcggaggaggcatttttggacagaaactggaggatgctgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaacgaaattcagaagaaagccaccatggggcagttacagaacaaggagaacaataacaccaaggacagccctagtagacagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaagtggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagc

SEQ ID NO: 367 - DNA, 3808 bp, Homo sapiens
aatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatg

SEQ ID NO: 368 - DNA, 2437 bp, Homo sapiens
ctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactactttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctg

SEQ ID NO: 369 - DNA, 3202 bp, Homo sapiens
atttctacagcagaaatgaaatcattacatccgcttcaaatgggtggactgaaagtggaaatgcccatgaacttaaaggttattatttatgaaaaacctcacttccatggacaggctaaagagtttagtgaacatatagattctgttcctaattttttgaaaaataatggagattttcacagaattggatcaattcgtgtcattggtggagtgtgggttgcctatgaaaaagaacattttaaaggccagcagtttctgcttgaagaaggagactttgaagacagtaatgcttgtggtgcattaagtagccctatcttgtctttccggtacttacaagctaattttatagaatcttctgtcacactatttgaatctgacctagaaagtgggaagtttattgacattacaaatcaggaaatttctgatttggaagaaattggctttggcagtaaaacaagatccattcatgttaaaagtggagtatgggttgcctaccagcaaaagttcttctgtggagaacaatacattttagaaaaagggaaatacaaatgcttttttgactggggaggatcaaataatataatcatgtcgatacggccaatccaactggaaccacttgggataaatgaacctccgcatttgctcaaagcattcagcaaaccagggttccaaggtgaatgtatagattttacagaagaaacttctgatttgacttcactcatgccatgttcttttaaagttcttcgaggttgctggctcctctattaccaagaagacatgtttgttaatcactgtgtgttagaagaaggcctctatgctgaccttacttcctgcggttgcccagcatctaaagtcaaatctctcaagcccattgactatgtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgagtaattttttagcaacacctgaaaatatactaaactttcctagataaactttaaggtttctatactgaggcttttataatgaacgcacctcgttaagtatttatacttgtaactaaccccaggcagggacctcagctttgttaggagtaaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaatatg

SEQ ID NO: 370 - DNA, 2419 bp, Homo sapiens
actttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcagagatctggttggagttggagggtgagagaaaatgaattctaatttacctgcagagaacttaaccattgcagtcaatatgaccaagactttgcctacagcagtaacgcatggatttaattccactaatggcccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttc

SEQ ID NO: 371 - DNA, 2798 bp, Homo sapiens
attgagaaaaaggaagtgggtcctgttctggttcttgcgactatagtcacctcccgaggcaaatgaccactgtcctgagaggacgtgggtgaggggcaggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggag

SEQ ID NO: 372 - DNA, 2788 bp, Homo sapiens
agggtatacagctatcccatgtaacatggtctgcggacagtaaagtcttactttttggaatggcaaatggggaaatacacatttatgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaggggttagagaaccttgccatttcacttccagaaaaccacaagttacttccaattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttatctcaccctctctcttttgtttatcttgtttttggttacatgataccatggaaatattccaaataaatttttttctcacagtgtc

SEQ ID NO: 373 - DNA, 3322 bp, Homo sapiens
agagaggccagagagacagcgggccccagcgcgcggctcggggctggggcgccagaagtgggactggagcgaagtagaggatgccgaggagaaaacagcaggcacccaagcgggcggcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactccttcgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccgggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgcc

SEQ ID NO: 374 - DNA, 3043 bp, Homo sapiens
atgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttgagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtttgtatgtatgtttaaagtatgtattgaccatgagatttcccagtgtttggtgcttaatgccgtttattttatttaagctaagaatgcatatgtaatccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgac

SEQ ID NO: 375 - DNA, 3085 bp, Homo sapiens
tttcttgcttttgaacccatgatgtctggctacttgtagatactcaatatttgtgggatgaatgaacaatttaagcctttttttttttaaccagaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcgtaagtgatcacgggctgcccgtgtcctggtcattggtagtgcaggcagaggaaatgcgggaaaggttgctgtgtttggagggtccacatcttcaccctcctgtcccaggagctttcctacactcctccttctcaaagctgcacacacctggggcctccaggggattgggggctgccgtgtgtgttatatcatgattagagctttcacttcctgctccctgctgttgggaaccaggctgtgtgtgttgcttaaattccccttgatgaccagcagagtcactgccactcagccatggcacactgctgtaaacctggttttgatctcctttcaatcttttgctgattaactacacattgatcagtgttggccaccctcaccctgccatagaccatccgctgtcttcctctgtagagttaactattttctcttttatgaggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagttgtcatgttgggaacatgctagacctcagtatccttgaggtaagatctctggttcattctctggaatgttggttccttgtatctagtacagttctgtacatgttcccaggggctttggggttggtgtaggggagctgagaggtgagatgagaatggcactgtgggtccccagatccgctgtccacccagccaacccagatcacctctggcctttcctgtgccttcagggcttgctgctggggggaaacctccagagtcccactttggtaataagaggtctctgccctttctccctgggcagcaggatgttgtaatggaaaatgagtggacctaggcttcagagactctggtcccctggctttgaatccccttctgccactatcccagtcaaggactgattcagaacctaattttcttcatttggaaaataatgttctgatagaggtgacttttgtggtacttgagaccatatgattcctatcattaccaaccaatattttccgattgtttttgccccatgtgacttctctgtgattcctcctggcaaggaagttttacaggaaagcagggccacttttgggatcctgtgctgggctggatcattttcctggactggacctagtccacaagctgctggcatctgtttctcctcatggatctctctctgcccttgtatacacctgcattcaaaaatgatcacgggctgcctgtgctctggtcatcaataacgcagggagaggaattgctgaaagccgtttcccgtgtttggagggttcacacctgtccctttcaaatgctggcgctttcacacactccttctctcctgccagcaccttctggtctcaggagcattgcaggatgttgtgtgagtgagtgatgggagacactttagtatggcttttttcagcttagcctcctgttatcagagagcagtctctttcagtgtcaaggtttgagtactagatggtggagaaagcctgtgtgaattatttttaatgaataagtgtgatgatgggtggcatacagtcactgccttaagattttcaaagagaagcagccttttggaggtggtgggcctgggcaggtctttcaaggagtgggatgtgatgggcagtagaaaggtattccagggaggggtagcaacatgagaaggtctttcaaggattgggatgtgatgggcagtagaaaggtattccagggaggggtagcagcatgagaaggtctttgagtctgggatgagcaagagtgtctagtcccaccagggagacagatgtgtaggcaagtaatgacagcatggagggatggctgctggggtgatccttggctcccagcacggcgaggtggacatctatgggaggggccctgagaggtctcttgagctgtctttctgccagttgcacatctgctcagttgcctgttaagactcttaagacagttttgctggactcttaagtttttattttgatattctttgggagcattgagattcctttttgagatgagtttggtatgaaagaaactggcaactcatacctgattgattaactgggggcattcccattgacttcagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatggtaagtgaatgccaagaggttaagttggcctgtgtttccgaggtggaaattccaggtcgctggcttcatttgtcttctcttttagattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggttctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatg

SEQ ID NO: 376 - DNA, 3866 bp, Homo sapiens
ttgggccccgggactcgcctgtgtcatctgggctgggccccacaaacaccacaaacaccttttccaccacgcaatagatggctgctgggctgcccaggggtgtgatgtggagctgggaaacccagcctgggaaggcagcattccaggagctgctttccaaaagaagaatagcctccaccaggaaggtgtggctgagccccagagccccagaaacctgcgggaagctccaaaggggggcctgccagaggatacacacccaccctacctcctgcacacgggatcctccaaccagacagtgtggcccaagcagcctggctactttcaccttagccagcagccctgggccacactggggatggtcccaaacatggcctgtgctgctgtcacggtgctaaggggcctggcaagcacggggtctttcttgctggacggaggcacaggtgccagaatctatcttttgccctacagtgtcccggcacagcctagatctatggaccccttcaccgggtgctttatcccccaccccccagaactcctgggaccattgagatgcccaggagatgggggggccctgtgcctgtgtcccgttgctactatagcagccaccacatctaccagctctgcagggtggccaccgggcacggcctcgccaggctgacgtcgaggaaagccagccgtgctgtgggtttccttccctctggctctccacttctgcctccctcttccactgtttttggtttgggtttttgttttgttccgttttgtttttttttgagacagggtcagctgtcttgcccaggctggagttcaggggctgttcccaggtgtaaccctagctcactgcaacctccaactgctgggcttaagtgatcctcctgcctcagcctgagtagctgggactacaggtgtgtgctcccacgtctggcaagcctctttcagtataactgtatgggtttttctccatctttttttcgtctttacaatttttgttctcaaggacttgggctgtttgacttgagtcttccagtctggattttgctgataagatggaacacctcgagagtgcatctttgttaacatttagacatgcgtcccctcctcgcttgctcagtggaattacgattgcacttggaaatgtatcgtgttgggtgtgttccttaagctgaacttccgtagatctggcaggacatttaacaccagaacacgaagcctgcttcagaagtgactgaaacggcatctgcctcacagtgcatatttaaaaaaatgattttgttgtgtgaataattatgctgccatctacggataagtgagatcagaaacattagtttcatatattgtagtttttagtttctgaatacttattggattctttttctttttttttgagatggagtttcgctctgttgccaggctggagtgcactggggcttggctcactgctacctccgcctcccaggttcaggcaattctcctgcctcagcctcctgagtagctgggactacaggcacccaccaccacacccagctagtttttgtgtttttagtagagacagggtttcaccatgttggccaggatggtctcgatctcttgaccttgtgatccgcccgtctcagcctcccaaagtgctgggattacaggcgtgagccaccaggcctggctccttttccactttcatggaccctcgtgattgcattggatctccccgggtaatctgggatgttcttcctggcctaaggtcagctgattagcaaccttagttcatctgcagtctccattctctttttgctgaatcacgtcaagtattcacaagttccagggggcaggaggtggacatctttgggggacattattccgcccaccagaaaacccaggagcagccgcagccccaagacgaggcagggaaggagtgctgctgtctgccggtgaagatgaactgcttctgaccctcccgagcgaggatattgagaagaaagaatttgccaagatgctagtcacacaccaagtacagaggctatgttggtcggctgcagcaaaaagaccactcgcggcgtggcagctctcactggccctgctgcctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacttaaccctggcaaatggccacagactcctttggggacagagtaggagcgtaactggtgggagtggttggcatgttttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccggttgatatcagggcaatcagtttcctggctgttttccccaatatcaacccgggcttacagaggacagtcaccacagagctcctgccaggagttcactcattcgtgcatttcttccttttttttttctttttgagatggagtctcgctctgtcgcccaggctggagtgcagtggagcgatctcggctcattgcaacctccgcctcctgggttcaagcgattctcttgcctcagcctcccaggtagctgggatagcaggtgtgtgccaccacgcccagctaatttttgtatttttagtagagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtcttgaactcctggcctcaagcaatcctcccacctcggcctcccaaagtgctgggattaaaggcgtgagccaccgtaccttgcccttggtggaatctttggggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttct

SEQ ID NO: 377 - DNA, 3085 bp, Homo sapiens
aacccaacacaaactcagttcagataaggggaaaccatgaaaccaacataattgccagagcacttgtgtcagcacttctgacacaaattatgtcagggtccccagcacctctcccaggctcggtgctttagggctcacgggactcagcctgtggtcatactcccagctaagattcattatagtggcacagcaaggatgcacagcggctctgtaagggaaaaagatgcctcacacggagaaagcctggagaaatccaggcgcagcttcctaagctctcccctctctcctgccaggcagggtctcacagagctggcccctttcctagcagcaagctgcattgacatgtgtacgtgtttttgcccagggaagcccactagagactcaagtccaagtttccattagggctggtcacgtactcattctttgccagtgacaactcccaaagctccagacttgcaaaagcagaggtgtccctgcacatcacactgtctgtatagacagcaggctggcacagaggccttatctgtgcaggagcattccagagccaagttcccagatgccagcctagggcagcgctgtaagcaagcccttctgaagctaggtctgctttgttaactctgtcttgtacagttgtgttgcttcattgtagttttctcatatgatctactctaacactgtattctttatttcagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagagtcaaaaaatggtgcagaacagacttcaacagtaagctccccattaaggtgaagataattcctactcccccgcgaagcaagagagttctctgggatcagtaccacaacctccgctatccacctggctatttccccagggataatttaaggatgaagaatgaccctttagactggaatggtgatcacatccacaccaatttcagggatatgtaccagcatctgagaagcatgggctactttgtagaggtcctcggggcccccttcacgtgttttgatgccagtcagtatggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggcagtggtggatgccggataccggaggagctaacatcccagctctgaatgagctgctgtctgtgtggaacatggggttcagcgatggcctgtatgaaggggagttcaccctggccaaccatgacatgtattatgcgtcagggtgcagcatcgcgaagtttccagaagatggcgtcgtgataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccggagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagctt

SEQ ID NO: 378 - DNA, 3066 bp, Homo sapiens
ctgcgcacccaaatgtcctccagtcagcctgtcctggctgagctcctgcgacctggctgagctcctgcctcctgtcggcctctataaacccagcctctgctgtatggtggcttcttcaggcccagctcttcctcctggcggtgtatacaggtccaactcctgcttcccaatggactctttaggccaggctcatgccttacggcagcctttcctggcccagcttttgcctgttggcataccctccaggcccacaatgtactcagatcagccactccattcccagctcttcttcctggctgtgtctacaggcccaactgctgcctcacaacaccctcttttggcccagctcctgcccagcacctggtggcctctatatgccccagacttcttaaagtcaactttgctaggcccacctttggcctcccagcggctttgacaggaccagctcttgcctcatggcagcttcccaacgccaggtttctgcctgcattgtggcatccttgatggacccaactcttgctttatgccggccttcccacaccaagtttctgcctgcctcatggcaggatccgataggcccagctcctgcctctaatggcctggttaggctcatctcatccctcaaggtggccaccccagatgaagctcctgccttttggcagcctttagaggcccagctcatgcatctcattgcctcttgaagcccagctcattcctcaaaacggcctatccacgcccagcttttccctttggtggcttctccaggcccagaaattcctcagttcggcttcgcaaggtgaagttgctgcctccctgtgccttctccaggcccagttcttcctcccagctgggtctacagtcccatctcctgactcaaaacaacctattttggctcggctcctgcccagcacctggcggcctttgtaggcctaaagcttcctcaagtcaagcgttccaggcccagatcatgctgcccaggggccttcacaggcccagctactgcctgacgatggcttccccaggcccaggtcttgccttcccccagcctcccgaggcccagcccttgcctcacagttgctttcccagtccacgttacagcctgttacccgacggccttgacagaccaaactcttccttcacactggacagtttaggacaagctcatacgtcttccagcctctccaggtcaagctcctgcctcacactggcctctataggcccaggtgctgaatcgcaatggtctgtttaggtccatctcatgcctttctcagactctccaagcgacgatctggcctgacacttgcttctgtgggccatgtgatcactcacactggcctctttaggatcaggggatgcctctccacaggccgagatcctgcctgttgtaggccccttcaggatgcgccgctgcctgacagtggaccctccaggcctagatgttacgtgatcatggcctctgcaggtcaagaatttaaattttcgcagcctctataggccaggctactgcctcctgataatggcttctgcaggcccaaatcgtcctgaaataagcctcgccaggaacagcacgtgtgttggatgcccgaacaaccatagcttctcccgcacagtggcccatgggggccgggctcttgcctcagcctggccacctcaggcccagttcttgcctgttggcggccgctccaggcccggctcctgcccctcggcctcctctccaggcccagaactggttcccgtcggcctctccaggcccagctctcccggccacctccacgggcccagctcctgcctcacgacaaccacgttcggcccagctcctgcccagctcctggcagccgttgtaggccccaggcttccctgcgttcaggcctcccggacccaccttcggctttccggcggccctgagagacccggctcctgcctgccagcggcctctcccggcccagctgcggcctcacgtcggcctccccaggccacgtttccgcctgcctcacggcagccccggcaggcccggctcccgcctgccgggggcctcttgaggaggctcatctcgtgcccggccgcggcctccccaggccaggctcctgcctgccggcaggcgccacaagcccagctcctgcgtcccgaaggcttctctaggcccggctcgtgcctcgctgcggcctcttgaggcccagcttttcccttgtggtggcctctccaggcccagaacttcctcaagtcggcctcccccggtccagtggctgcctcccggcctcctctccgggcccagctctttgctcgcgtctgcgcccgtgggcccagctcccgtctccaaacagcctccttcgactcggctcctgcccagctcccggcggccttcgtaggcccgaagcctcctccagtccagctctccagggccgcgtcttgcctcgcctcgcctcccctcaccttgcctcacctcgcagcagcctttccaggcccagctcccgcctcccggcggccttcccctgccacgctcgtgccggcctcccggcagcctccaccagcccggctcctgcctcacgctggcccctctgggcccagctcatgcctcgcggtggcctctccgggcccagctcccacccagcctgacggcgcctcccggccccaagctgccttcctcgatgtggcccaaagtggcccaaagcgtcccaaagtaggcctcgccaggcccacctcctgcccggcgtaggccctgaggggcgcggcccctgccccatactggcctcttttgggccctctcttacaccagcccctgtctcaggattgtctcttcacgcccatcttctgcctcatagtggtcactcaaggcctcgcttttgcctgatgattgcgttttctggttttgctcttgccttgtattcccttcttcgggatacagcttttacgtcttccatggtgaacctcatcaaggagactaaatcttccctggtctgtcatttttttcacttcacaccagagtgccttgggaaaaccccatctcttcttttaaccttgagagtggatttctgacgaattgataataaattttttctctgtggtttc

SEQ ID NO: 379 - DNA, 3125 bp, Homo sapiens
cagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttcctcactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttatt

SEQ ID NO: 380 - DNA, 3207 bp, Homo sapiens
gcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcatttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttccttctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgccctctttagcagatgatctgtaatttggtcattgttctgttatattccagattgctctacttgctaatatttgtatagaatagaatttatgtaaactagtaaccagttgatctctgtgccaaatacattatatcaggattacacaaaaagcatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatc

SEQ ID NO: 381 - DNA, 2541 bp, Homo sapiens
cagcatgggttgttgataccagtgtagtggtagtgtgaggttctgttgctgtttgtttgttaactgttaattattttccacaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggacgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttc

SEQ ID NO: 382 - DNA, 3109 bp, Homo sapiens
ttttaaattcatggccaccagctcaagtggacacttgttgactgctacatttccccagcctggtaccacccaaacatgtcctcgtgtcctggcacacagagagggcagagctgggatcacactgcctgcccctctaaatgaaaggttgctgagcagagcgggaagctgcacctttgcaggcaggtcaaggacctggcttctgggacccagggggaccccatgtgaaggggagtggggctgggcttgtctagaatctgcctgaagtggggacctggaagagtgaaactgaaggaggctggaagtattcacccgaaggcagagagactccaggccccgaaaaagtgacccaagagggacagtcagctttggtcacctgggagcccaagcagtgtgtaggcagcaaagacccccggcccttgccgctggcctttgggctgtccccagagggtcaggagctacaactggagaggaagtgggcagagcccaggctggagtaggaggcatttcaactcagagtaaagttgggagttttgatggttacaccggccaggacacaaaaattacttcagtgagaccaaatcgaaaatgggcatgaaaacggggccagattttcacccggtggtgggtgtggggtggggaagaacactgggggaaggaacaatacaagtgatttgtttctcttctattaataactcgcaaagctgcaaaagtgggtgggggcttattcaaatgaatgtaattcttctgttaccttcaaacatcagtgacactatatgcacaggggaccatcagggggcgggcgctggaggggtaattcttccacctctgtggcacccagctgtgcgcctgcagactgatctgtctccctccctcttgcaggaaaacacttttctatgaattcacaatgatatttgtactatgctggggctattgttaggagttggtatgatgaaatattcagcattgtaaacagtgtgcacacaaacatgtctcgagtgtgtacttgtactttgctggtgagtggaaagcagagggtgatctttgaaaagaggctggactgcttgctggaaaaccttcaaaacaggaagcagccactagattcaagtcacattcctgccggaggctagacgtgatcccccaggccggaatcccagcagtgctgggcgggcgtgtttatttgtccttgggtacatgaagcaatagctccgttgctcctccgtgagagattgcagaatgttctggctggaataaccagtcaaggtagtgtcagaagacagagttacagcagatctagtttagaggccttcattggcttgcgtttgctcttctagaatgggcaacacctcgttcgataaaatagagaaaagggccgaggaaagcagaaaccagaacagaaagctgattggtcttttcacagttaaaggtttaagcagagggcttccctactgtgctagctgaaactggcctgtttggggatttggctacgatctccttctctcctgatttcttagaagctcaaacaattttctcttggtggtgtggaaactcagcgcaaacaaccctgtttgggtttggtctgttgggcttagtgcgggagccctgcccaaagccagtgcctcctgtcaatttcactgcacactgacatgggaccaacatgcctaacactcgtctgtcccgtggaccctgtctctttcatttttttatttttagtttttagagacagggtcttgctctgtctcctaggctggagcgcagtggtgcaatcacaggtcactgcagccctgacctcctgggctcaagggatcccctcttctcagcttcccaaggagctgggactgcaggcatgtgccaccaggcctggctaattttttattttttgtagaaacaagttctcactatattgcccaggctgatctcaaactcctggcctcaagtgatcctcccacctaggcctcccgaaatgttggtattacaggcatgagccgctacacccggctctgtctctttcaaagcacaagtccacagttttgctgacacgtggtggcgatggggaaaggtcagcagggagtagagaagagaacacaggcttttgccactgtgtgaggtggcagtgggagagtctgcagatagcaggggagcagaaagcaggggacagctagggctggtatctgggctctgctactaagaagctgtgtcacttggagaagcgactcacctctgtgaaggtccccatctttaaaatgagggtgaccacaacagcactgccctctgaggctgccatgattccgtgagttcacgagggcactgcatttggtgcctggcaaattacagtgcttggtgggtggtgcctgtgcctgacactcctgccctgtgttgttacctcctaatagccagcgaggggaggtgtgctttccttatctcgcacaggaggggactgaggctcagatagtccatggccacatgaactgggactcggaaacaggccctcatggctgtaagtgctggcctcatttcgcgttgcgtcaccaaaaacagacaggatcagtgatcagctagaggggccaagcaggggcaggagggtgggaagagtggtccctccaaggggacccagaaaatgccagtgtgacagccctcggggcccctggctgggcaagtggaagacagagcactggctggagccgagagctggcaggactgagccttggcctccgcaagagccccagcaaaagccagcccggcacaacagctttgcccctcggtggaagcccccaggctgcgtctggagtggcagagctcgcattccaagctcagagacactgtctccaagagccctgcgcttctagccgagccctttccctgggtcaaaggagaatggtggagctcttttggggtacactgagggggcccaggccaggctttgtagggaaggccctgatgaccagtaactcatgaggactaagctctgatttttttatcttgcccaaattcctatcttaggggtctggggagtcatgccctacaaaccgtaagttctcatgggatgggttttatttaaccctatatattgtgacttactttccaagctgactctggtataacattacgagac

SEQ ID NO: 383 - DNA, 2991 bp, Homo sapiens
agtgggcggggcgggcctggccgggccgggcggcggcgctgcgctgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgcgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttc

SEQ ID NO: 384 - DNA, 3816 bp, Homo sapiens
gcggctcccctctctcgggcgtgaggagctggcccgctgagctgctgttgctcccccgcctgctgttgctcctccatctccagatcggatcacggtgagggaaagatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgtcaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatagatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatataacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttatactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaacagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcctcattaaaaact

SEQ ID NO: 385 - DNA, 3349 bp, Homo sapiens
gttattggcgcttgctcggcatttgtggaccgaacaggcaagttcaaccgagcacgctgcccccgcgctccacctctgagttccctgggccactgcgacatggagaaaccccgttcttttcatcctctgctatggagaagggacgaggacacgggtcctgcagtgttggtgtggcgaggcccggaagaagagagaatgggcggcggggactggccacggcgctgctagttatgaaaaacctcctcctgggcttatcaagatggagtttcgctcttgttgcccaggctggagtacaatggcatgatctcggctcaccgcgacctccgcctcccgggttcaagcgattctcctgcctcagtcttcccaagtggctgggattacaggcatgcgccactatgcctggctaattttgtatttttagtagaggcggggtttcttcatgttggtcagtctggtctcgaacttccagcctcaggtgatccgcccgcctcggcctcccaaagtgctgggattacaggtgtaagccaccgcgatggcctgctgtgttttaattttctgacatcccctttgactcatggattggttacgcatgtgttattcagtttctacatactggattcttcaaatttccttatattgttgctttgtaatttgagtccatcctagttagagaatatactttgtatggtttaaatccttttaattatattaattcttgttttatggcctaatatagggtctctggataatgttccatattgacttcaaaaagtgtttattgttgggtggtagagtgttttataagtaactgttaggttcaattgatttatattgttgtttaagtcttgtaattcattgctgatcttctctctagttgttttatccattattgaatgaggagtattgaaatctctattattgttacaccgttctattttccccttcaattctatcagtttgtgtctcaactatctggcactcttttgctaggttacatacatatttataaatgttgtatcttcttgatggattgacctttttatcaatacaaaatatccttctttgtctctggtaacagtttttgtcttagggtgtattttgtctgaaattatcggagcagctttagttccctttgggttactgtttgcatcatatattcctttccatccttttactgccaacctaattgggtctttaaatctacagtgtgtcacttatatctagtgcttggatagcatttttcctttttttttttttttttttttttttgagacagggcctctctgctgcccagggtggagtgcagtggcacaatcacagcacactgcagcctagacctcccaggctcgggcagtcctcccgcctcagccttctgagtggctggaaccacaggtgcttgccaccatgcctggctaatttttaaaaattttttgtacagacgggatctcaccttgttgcttaggctattctcatactcctgggctcaagcagtcctcctgccttggcctcccaaggtgttgggattacaggcatgagccactgcacctggcggataacatttttatccattctataaatctctgccttttgattgaagtgtttaatccatttgcatgtaatataattactgttaaggtaattacaaacctatgcacatggttttgattttaccaattttagtattaattagaaaagtggttctcccactttgatatttctacaaataaccagtaaatcttttaaaattcaggttatatgtccatatcaggcccagcccagaaatactgaatatccagtatttgaatatccaaaatactgaatactggatattcaatatttctgggttgggtcctataccttgcttttctaacaaccttgctcatattgttgaatttgctggtccatggaccacactttgaatatctgggatcacctttccataataagaggattttgagcggaaatggtatcttctggatatctatacatcaatgcttgttccatggcatttcacatcccttcagctttgccataaaggcacatattagtttgaaagagtgtagtccttctcccccaaactttaaatggtgagggagataaggatagggatagctcacaggcaatcaatagaaatccacaaacttaggccaggcacagtggctcacacctgtaatcccaacactttggaaggctgaggtgggctggtcacgaggtcaggagttcaaaaccagcctggccaacatgacgaaaccgtctctaccaaaaatataaagaattggctgggtttggtggcatgcatctgtgatcccagccacttgggaggctggggcggaagaattgcttgaacccgggaggcggaggttgcagtgagccaagatcgcgccactacactccagcctgggcaacagagcgagactcgtctcaaaaaaaaaaaaaaaaacccacaaacttaatttttttcagtggtttcctgcattcaatcctcaaataaaaataaaaagagaaaaactttcttgccctgtcactacgtattttctgtagttgccagcatagagcaaacttggctgaacttacctaaatccctcttcatacttcccgacctagttgcttagaattgcttaatactcaaacacagggtctcattcaccattcccatacagtttcctgatttacaccacatccagatggtgctgagaggatatgaacaggcgagagaagtaacaaggatctcatccattcttgcttcactcaccacttcctttttctcagaggtcaatgcctgatgccaggtccactcactgaaattccatgaagactggaatttgttgccttggagcatgtatatacattctcttgttattctcctcccagttcctcatcaggaccttctgttgcttctaatagttaacctctttaaatagcacagtttccctcttctgcaagtaaagttgcagtagggttctgatggcattaatattttaaaagaacttgtgattttgtttacttaaaagtgagggatgtgaacagatgtcgactcaacctgagaaagaaggtatttgttctagtgactaaatttataaatgagattcagagccacttgattaatagaagatatttactttgaaaaatacagcgagacacactaaaaaaattgaccttttgcagtacttttcattggattgcttcataatttcttggtgttggaaaattaattcctaaagcacaagattaaaggatgcttgggtaagcaattagtttacctgtcttttctgggaccttacacggttcatccatgattgcattttcttttagaattggagtttaatgaataaaaactttaatataatct

SEQ ID NO: 386 - DNA, 3572 bp, Homo sapiens
agtggcttctgtgccccgccctgcgggtggtttgctagtttcaagcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtagaaagaacaggtttagtatctgagcgctgtggcctgtttcctcctgaaatcccagatcagagtgaggggcattcctttaacatccaggagttcttcatctcttttttgtaccgtgaacctccttggcagtaaggtgaagtccctggactccttctcagaataattttttttttaaaatacataaaccataaaggattacaaaagaacgcagtcatatcaacatacagtttgcaaagtattaactttgtattaaagtcatacttttttttattagtacactaaataataaaacctacggacagggcttataactggcaattacaaagcagtgataagtatctctttgcttggttgtaatgtgatgtaaaaacatctgcaggttctattggtgacaaagtcgtgggtactgcttatgctacattgatttgttgcttccattcataattggaaggaaatgctaactttctcttaaagactagttaaaaataagattagcttttgtcctgttcaagttcatggactacgtgggaaggagttcatggaccactggttatgaacctctggtagaaaatgggccgacttttacctccatgttcttccctgttttatgagactgtgtcctctttgcatcatcctgtgtccctgtgcacacaccctcagaggacctgtgtggccagagccttctaaatggtgagctggataccagggttcttgacttgggtctgttgcacccaaggcctgtaacagtggaaagtcagtgcgagtctcttagcttcattctttataaaggatgtgggaaattctgagctgcacatgagaaagtaacttgaaaactgtaattttataataactataaatgtctggaaggaaacctgcatacatatcgtatgccaggccatgttaggtgatttcacgtactgtgatgttgtttgggtcccccaaactccataaactagagattgtaatccccttttcagataataaaaggtattaatattctctgagaattttgcaccagtttccatggattttcataaaagcacaaatgtatatatgaaggagcatagagtaatgataagaacgtgtgctctggcatcattctacctgagctcccatcctagcattgccactgattagctatttaaactggctgtgccttaatttccctatcagtaaaatgggtataataataatacctcccttataagattgttgttttctgcgttaaatgagttaacatttataatgctcttggaaatagtgccagccacctaggtagttctatggaagtgtttgatgaaaacatgaaaataagaacaaatgatttctaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccatgcttgcccatgggggatgctgcagagaagatgcagtggtagcttctaggcttactccagagtcccaggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggactacaggtgtgtgccaccatgcccggctaattttttatgtttttagtagagacgggattttaccgtgttagccaggatggtctcgatctcctgacctcatgatcctcctgcctcagcctaccaaagtgctgggattacaggcatgagccaccatgcccggccaagaatccatatttctttaccagactaggaattctattctagtgcaaatgccttaaaaagcttatcactaaatcattacgaatgtgtgccatccgtggaattgctttttttttttttttgtaaatatgaggtctcactatgttgcccaggctggtctcgaaatcctgggcaatcctcctgcctcaccctctcaagtactggaattacaggcgtgagccaccatacccagcccaaatttcactctttaatgttttcctgttgctattctttaaggaaaaaactttcctattcagacagtgtgaaaatcagtcatcaagtcagaataaaatgatgaatattct

SEQ ID NO: 387 - DNA, 2590 bp, Homo sapiens
gttgatcccgtctcccaggtactgagcatagtacccagtggttaggttttcattccttcccctgccctcctctagtagccccagtgtctattgtcccctctttgtgtccatgaatacccaatgttgagcttccaccgtcgcatcagaccatgcggtgtttgcttttctctgtctgcgttaattcgctgaggatgatggcccgcagctgcatccgttgctgcagaggatgtgattttgcgcttttctatgcttgggcccactgtctttaacatcaagtttgtgtttcttatcacagctctgggtgctttacccagcagcctcccccatgcccactccgcagcctggacgctgctgccggggcctccagcccagcagcacagcactcgcctgtggaccttttcaaatatggctggtgtggagctgtgcccagggccccagccagcgggtcctgctgcccctgttgggaggacgccgcctgtcctctctgctttcacaacaacctcttccttcgggtctggctgtggcgtcacctcctccagggagctgcccctgcgcctgggctgtgccccatcctctgactcggcactgcctggcccttgctgtggtgctagtctaggcctcctcctctccacggtttcacctgttacggggctcctgaggacgggaaccaggctttgttcagaaccctggcacaggttctgtgccacggggtccttagaatacgtgtgtgtgatggggaaggcgcagggcgtgtcttaggcacactccatggtcccctccacccttcacgcctggcccagagctggtcgtgccatcagggccctcaggagccaccgctgggtttccctctttagtttagggttcagtcccaggaccgaactaggagatggtgccatccccgccatcctccacagaagtgtcaggagcagggaccacctgtcattctcccaccctgcccatcacaggctgacggccgcttctgcaacgccctttttacaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccacaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctggtgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgactgtggagacagcctcgggaagccctggcccgtggatggatcccttggctgtctgaggactgctccagaagtgcgggaatccagggcccacccagaagaccgtgaacagttccttagcctcccaccccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgatagtg

SEQ ID NO: 388 - DNA, 2357 bp, Homo sapiens
gactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagccccccaacccctcccctcccctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatggggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttaccagaagggtctgaaaagcagcagcacagagtaggtgaacacaggcctgcaagtgcgaccacctcagacccagtacgtgtgcctacagtggacacactcacacctccaacactcccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaac

SEQ ID NO: 389 - DNA, 2685 bp, Homo sapiens
atacccatagttaccactgggagcagggtgggccgtttacactcctcatcctacctcgccatcaccttaggaagcagccattctccttgtctttactgtagaggaggaagcctggacagcctgcagttgaggggacctgcacaagctcacaggactcttcatcaccatgacaccacgctcaccgcaaaataaaaatgatcaaacctgtcatgatgtcagcagcaccggtgttggtctttgtgggaaagaaaaacacaggccagggctgcagcacgattgtgtctgcccagctcttgcagcctggagaacaccgttggattccctcccacacatgctcccaggctgcctgcctgcctcacttacctgctcagggtggggcttgagggtggcccctgggaagagtaagaactggccaagactgagatgtccttccctcatttaaggtaccgccttttcccttttcccgccatcctgggtgcatggatacttgggattagaaactggactggaaatgtaatctttcttcggtttggggctgagaactggggattagtaggattttgagtttatggcacagccttttcttacaccatttcctaaaaagcagttaagattacaccaggcacagtggcttacgcctataatctcagcactttgggaggctgaggcaggtggatcaagaccagcttaaccaacatggtgaaaccccatctctactaaaaatacaaaaattagctgggcgtggtggcacgcatttgtagtcccggctacttgggaggctgaggcaggagaattccttgaacccgggaggcggaggttgcggtgagctgagattgcaccattgcactccagcagcctgggcaacagcaacgaaactccgtctcaaaaaaaaaaaaaattacagtcatctcccagaaaaatcaagaaggaagaaccttggaggttcaacctatagaagatatgttctcatggaataaaccaaaaataatttttattttctaaaaaatcaagaacagaagtctctcaacatttaagttttacaaacaaatagaatctgagccactgggttaaacatgacaaacgacacacagtaacaaatattgaagacatcataatgccaaagcaacagaagcagcaccagaaatgttgctgaggccaccatttaattaacgcaagttgaacatatggctttggttacatgtggttccaggccagaggcatggaagtcagtgtttgtgggaaagccaggaggaaaagctcctctccccacctccaccttgtcactccaggttctggtgaccccatctcgggacacggcctcccatttcactcctgcaccaaccccactcttgtaacactgcacatgcaagatgtgagcatcttcaaagtacgaatattgccttcttcattttagaatccatgatgtgcttgtggggagaatgaatgaatgctcaaacatgaatggagagagacagagaggaagtgcaggtctaaccaaggaaaccttctttcctagaaaatcgttgatgagcccggaaagagttggctgaacaacggtaacaattcttttattattatttaacttattaagttattagaaaaagtaaaagagtgagtcgaggtttttggattggaagtagggacccactgagttccctccaggattgtggagtttcttttacagccacatgtggataagaaactaagggccacagaccaaatgacaggtcggatggcaaccctggaaaagtcacacagctcagcctgttggaggaagaggagcagtagaacctgtgtggagcctgacagaacccaagatgccattcacgaaccgagaggtctttcaagatcacacacagttctacgacacagacatttcgtcttcttgccactcagtagcggggcccatccctctgtgcctccaaggagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgaggaaatacctctgtacactcaccagacactggctgctggttgtcacggtgctaagagctgtgggaaacatgaagagcaatgagaccaggtccctgctctgaggagacgtgtgccagcgaagtttctctcccacgtgagtgtgctacaagaaaatctgaacccgagaatctgattcagtaggtctgcactttccccactttgccagataattctgattgagaccgtcaaggctgtgactagtggggaggcagtagagtattttctgtgctagactgaggcagccctgaagcactgcgcaagcacatggaaaagagaaacgagattgggccgggcacggtggctcatgcctggaatctttgggaggccacggatcacttgaggacaggggtttgagaccagcttggccaacatggtgaaaccttgtccctactaaaaatacaaaaattagcagggagtggtggtgcacacctgtaatcccagctactctggaggctgaggcaaaagaatcgcttgaacccgggaggtggaggttgcagtgagctgagattggaccactgccctccagcctgggtgatagagtgagactccatctct

SEQ ID NO: 390 - DNA, 2854 bp, Homo sapiens
agaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattagaaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttatcgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccaagtacatttagtatggcattgagttgtgatatagttttactttgatgtgcatttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctgg

SEQ ID NO: 391 - DNA, 2743 bp, Homo sapiens
agtttaagctaatttttttcttatttctaaagcaaaacaaaacccaaactcattgtaatcctctttggaattgcattacatgtatatgttcagttgtgaaggcatgacattttatgatagtaaatcttattctggaacatggtatgttgcttcattttattcgtgtttttttgagacggagttttgcttttattgcccaggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatgcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccggcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgtggacttctgcggcttttccagcccagcagcagccgctccagcccctggcacccaccactgtactgtctgtctctgcggattggaatgcacttctccagcgacctaacaaatacatatggggactccagtacctggagatgtgaattccataaaaatggaagcatctaagaggcaatgaacactggcgcccacaggagaaccaggtgcatcagcgcattgcggagctgaggaaagcaggtctgtggtcccagaggcgtctgctgaagctgcaggaggcccacgacccaagtcccactgggactatctgctggaggagatgcagtggatggccacagactttgcccaggagaggtggaaggtggcctctgtgaagaagatggtcagagctgtggcccggcagctgcaggacaggacgcgcagggaggccggggccaggagggaggagccgagcaggctgaggcagacgtcacctgtactaccagagaaatcgagcgtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccaggtagcccggcttactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgttgtgataaggcagctgcaaaaagcggcaggtaggcagccaccttcgcctcaccaaactcgaaacaactcacttgagtgagttgcatcaaacctttctaaatttctcattctagaagttgctgagttgttctgccatgtgttaacttttttttcttatcagtaaaatcttttatttggtttatatttcaaatgtaatttaaaaagtctataagacaggaaattcgataatatgaaagcagggagaaactaagtcgcaccatttagctaagctcagggacaacgttcatttataataaatcaaacatttgatttttttcatgcc

SEQ ID NO: 392 - DNA, 2723 bp, Homo sapiens
tatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcagtgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgctctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaaggggtagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttaatagagcctatgagtaggttaagagtatatatgtgtgtgaaaagttaaaggtgcaaaaccataattgtttgttttatttgagatggagtctaactcattggagtgcagtggcacaatctcggctcactgcaacctctgcctcccgggttcattcaagcaattctcctggctcagcctcccgagtagctgggattacagtcgtgtgccaccacatccaattttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggctggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctcctttt

SEQ ID NO: 393 - DNA, 2811 bp, Homo sapiens
ttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttttcctgtgttgcccaggctgacctccaactcctgggcccaagcaatcctgcctcagcctgccaagtagctaggactacaggcgttcaccactgcgcccgcaaagtttttttgttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccagtaccacaggcaagtgcaccaccatgactggctagttttgttttttggtttttggtttttggtttttggttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgc

SEQ ID NO: 394 - DNA, 2690 bp, Homo sapiens
tttcaccttgttgcccaggctggtctcaaactcctgggctcaagcgatctgcccacctcagtctcccgaagtgctgggattacagatgtgagccaccatgcccagctttcttgcattgttaagagcaagcaagagctctgaagccagactgcctggccttgaaaatctcagcttggtgtacagtcttgggcaaagtgacttaacttctctgtgcctcagttgctccatctgtaaaatgataatatattcatatatgtatgttatatatttttgaaatagagttttggggatcaaatgtgcttatctgtggaaagctgttggcaaagggcctgacaatgtatgatgtatgaagacatgctaagcatcatgcttgctattgaaatgaagtatagaggaggaaaaaagcatcatgcgcggtatttttaaatacattgtttcatttaattcttctaacaagcttcattgaggaagaaacagagttacttgtcatagtcaatacagcaagtaagtataacaggagagccaggatttaagccaggtctgactaactccaccatcctgcttctgaatgaagagagctggactccagaggcactgtttatgggcatatgggccttttctcactgtttggggccagagaagaagcccagagggcagtttgtcctggaacatctcagcatttttttgtttttgtttttgtttttgttttgagacaaagtctccagtcccccaggctggagtgcagtggcgcaatctcagctcactgcaacctccacctcccaggttgaagcgattctgctgcctcagcctcctgagtagctgggattacaggcgcctgccaccacgcccagctgattttttgtatttttagtagagacagggtttcaccgtgttggccaggctggtctcgaactcctgacctcaggtgatccgcccgtctcggccccccaaagtgctgggattacaggcgtgagccaccgtgcccagcctttctccaggtgggagtgcagtggcatgatctcagctcactgaagcctcgacctccggaactcaagtgatcctcccaaagtagctgggactgcaggtgcacaccaccacgcccagctaatttttggattttttgtagaaacggttttgccatgttgcccaggctgctgatctggaacctttggcttttgttttgttttgtttttgttttttgagacagggtctcactctgttgcccaggctggagtgcagtggcacgatcttggctcactgcaacctctgcctcccgggctcaagtgattctcccgcctcagtctcccaagtagctggggttacaggtgcacgccaccacgcctggctaatttttttgtaatttttgtagagacggggtttcactgtgttgcccaggctggtctcgagctcctgagctcaagcgatccacccgcccatgcctcccagagtgctgggattacaggcgtgagccactgcacccagccctcttagccattttgttaacctcatttcccacctctggaggtggtaggggcttcccaagaagatcacttggacctcttcaagtatggtggcaatattgctgggctgttggagagacttctgttatagaggctcccctcttgtgtttttcctcaaaggcaaggagtcatttttggtcacatgaggacaaagagaccagaccagtagtgcattctgttttgcatgggaattgtcaaggctctttcagttttaactgaaacccaactcaaactggcctaagtcaaaaacgaatttattcatctatgtaactgaaaagagtgggccacaagggggaggcttcaggctagctgcatctaggttttaaatcatgtgaacagatctccctttccccctcccccatctcttgactttgctgtcatctgttagtttcattctgaagcaggcttccaccgtgaaatagaagaggtggcaactggtgacatcatgagacgatgtgtaatctgagcaaccctaaccaagaacttattttccttagtagttccagcaaaaatccagagaggactatccttggccaggctttaccccatgtccacttctggagccaagaaagacagttccttctccaaggggaacccagggtgttgatactagaagatggaaatggatacagtaagatgctgccacagtgagatgcctcacccaggtctccctctgtcacttcagccaagcacatgggatagaaagtagcaggcggcctctggccctttaatggaagagggccatccagtcctctccagttaacatctagaccgaacacaaagcatccttctctcatccagaagacataggaaccctaccttcagggatgatttttttttaacagtgaaatcttaaaagtaactgtttcactaaagcctccagtatttactgaagactgtcagaatcatcctccatcactagatcttctccaccagtcatgttccctgagcagtggggtggcttgaaggtataaaccagagaggcccaagggagggatagttagcagacttctggtctttttctagtttgtgctcttctgttccaaggaccacaggtatgtcttcttctgtgtagttgttcactattgtttcaatgtgattcgtttcccacatttgaaaatagggggggattttactttaaaattcagatatctggctcctctttagggg

SEQ ID NO: 395 - DNA, 2616 bp, Homo sapiens
atttttcctgattggtagactaaggctcagagagaggaggcggcattacccaaagccgcacagctggtaaatgggaaaagaggggtttaaaggtacgtgccctggaggaggccaatgctgacctggaggtgaagatccatgactggtaccagaagcagaccccagccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagtaggcgcctgggcacaggggaaggagtgatgagggctgcttgtggctagggtgcagggtcatcctaagggaatggcagggtgtccctaagcagccttgagggactgtgaaaagagaactgagcaaggagggaggatctggactcctcactctggtccttggctgttacctgggacaggtcacttcctctctctggatccgtgtttcttctgtaaatgatagaggctgggctagtggtagttaagatctagtgctcattccattctctgcatgagatagatgggtattcttgtagttcagaatcttgaccagctcagtggctcatgcctgtaatcccagcactttgggagtccaaggcgggtggatcacttgaggtcaggagttcgagaccagcatggccaatatggtgaaaccccgtctctactaaaaatacaaaaattagctgggcgtggtggcgggtgcctgtaatcccagctactcgggaggctgaggcacaagaatcacttgaacccgggaggcggaggtttcagtgggctgagattgtgccactgcactccagcctgggcgacagagtgagattccgtctcaaaaaacaaaacaaaacaaaacaaaatctgtctacttggggatagcaggcctggatgggctagcaggatgtcccacccctagaggagtcaggtgtgtgggtggtggtggtgtagggtctgaagaacactgcatagctatctacatgagcttcccttacggacacttgagcttgtgccctttgcttaaatcagcttccctctttctttcaggatggctggcattggcatcagggaaggtaggaaggctttactcttctggtgtggggtggggaggggagatgttgaagccaccacccccttcggaatagggaggaaggagaaagagcccaaacatcccattaggtgggaacattcccattcattagatgcctcttccccagtgggaacttctgtcagccccaggtgagattgcagctggtgatttattgagaaacttccaggttgagtaggcttcattcagggcatgtctctcccccaggccccatcttcatacacttccgctaagatgcccacaattcatcccccttcatgtgcagcttgaaaaaccctgacattgttgctccctgccgggcatacctgccattgccactgcccatctctgtgatgaggaattcaacaccagatctctggcagctcttgagggattggccagtggccattctcaggggtgctgtctagttttcccagagccccgccaaggtcctggccaccgtggcagagcggggaggttcccccactctaaagcctactccttctctctctagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcccctccccaccttctttggagcaaggagatgcagctgtattgtgtaacaagctcatttgtacagtgtctgttcatgtaataaagaattacttttccttttgcaaat

SEQ ID NO: 396 - DNA, 2821 bp, Homo sapiens
attcatttggtgaaatgtctgggaagtgtacggctggcaggctgaaaaagtcctgggagaaaataactcgtgctggagagcagcaaagtccttcccactggaacttcctagacgagtcctttgggttacacatctggaattacttttactagacaaatctcttttcactggacgtctctgatttcagaatgtgtgataattcagacaccagtttgttgatctgaagttgccttcatcatattccatgatagaggatttaccaagcaaatgtcggaattatcgatgctttgaagtcctgtaaggcccattttgaaccgtaggaactgaaatgttggttgattagaggcactgatgctctgggtgtggtgtgacagaagcgtgagagccgtgtgcagggcctgggtttgcagcctggctctgccccttgcaggctttgctcacggggtccctgtgagctgcttactcacctgccggggaagtgagcgagtccttcaaaggcggcgttgaaagccgacaacaaaggcaccttaatacacctttgaagatactgcctcggtctcaactccaccacgaagactaagacgtctctgtctgccctgtgaaagcgtttaaggacatggctaatttctgccatcaataaatttactggtcttattctattgggtcactataaaactggcaacaagcaaacaggtcttcagcaaaaaagcactttgatgctcatattaccccaaatcactgtgatcattaaggatagaaatcaagaaggaacaacaaaatgtgcaggccctaaaacagaaaggacggacggagcgaagcctcctgcctccttcctcttcccagctttgcagcaggtcctcaagtgggcaagggctgtgggagttttcttttgctgctattatggtaaattaccacaaacttaatggcttaagacaacacaaatttattatccgagagttctgtggttcaaaggtccactacgggtctcactgggctacggccaggtgtcagcacactgcatccttctggggactccaggggagcccccgttttcttgccttttccaggttggaggatggccacctcactgggcttgggcccttctgtcttgcagctgcagcagcatctctctgactgtatctggcagcgcagcccttcctccgactcctctcccttcctcctcaccagaagcacctgggatgacattcacccactggatgatccaggagaatctctcgtctcaaggccaccgatgagcaaccatcatcctctgccatggaacctgacacaggctcgcattccagggatccagacgtggatgtctctggggccattgttccctcgaccacagggaacaactgcatgggtttccactggtcaagacagaaatgtcgcatgacttggccgaagcagctgcagtgggcagccaggggtggaggcctctgtcctccactttgaggctctggtcaggcgtttaattccttgctccggagatattcccagtgagtcggctctcgttaaatctcagaaaattcggtgctgtggagtggatgagactggtgtatcattgtttaggcctcatctgagcctatggattctgtctcagtgatggggaccagcccaggccgctgtttccacaaaagaatgactctaacagcagaaaggagagatgtgtgcagagtgagacctctggcctgccatgtgggggaacccgcccggctcccggcagtgtctcttgggcggcctctgggccaccagcgtctgaatcccggaggacttgttaaggaaggaacctactcccagtctggtccctcagaatcagagtccctggtaacaggggccagggaagctgcacttttcccctgtgattttcacgtaaaatgaagctttggaatcaccagtacatgggcatgggcatgggcatggacgggccagccggatggacggccgctgccgagacggaaacctgggagcactggtcggtctgtctccttcaggtagtgctcaggaggctcgaacacacctcgttccccgtggcactcatgcccacactcatccctgaaacttgagccaatgtaagaaacagccgtgtgtggtgatccatggggtgctgcaggcaacagatgccaaatgcggtttttgtgatgggagtctggggcgggataactgtgggtgctgcgggcaacagaccccgaatgcggtttttgtgatgggagtctggggcggaatagctgttctagagccgtgaagggatcaagcacattcccaaagcccctgctcggcataatgaccttattaagtccacgttttctttcttttcctggtagataggatcttttctaaccttttccacctaagattcatacataattcccttccccagcatgatttgtaacggctgcacggtggaccatcccttgggaggcccatcatcattcacctcaacaggcccctttcctgggcctttaggtaaatctacatgttcttttcgactgaggctttttggcaaccacacatgaaagtgatggtctgggccgggcgaggtggctcgcgcctgtggtcccggcactttgggaggccaaggtgggtggatcacctgaggtcggcagttcgagaccggcctggccgacatggcgaaaccctgtctctactaagggtgtgaagattggctgggcatggtggcacatgcctgtggtcctagctactcgggaggctgaggcgggagagtcacttgaacccgggaggcagaggttgcagtgagctaagactgtgccactgcactccagcctgggcaacacagcgagactccgtctcaaaaaac

SEQ ID NO: 397 - DNA, 3559 bp, Homo sapiens
cagatgtcttggtagtcgcggctctggcgctccgcaccctccgtctgcggcagcgggggctggcggccccggcccctgcccggccccgtcctccaacctcatgcctcagccctaataccgccgccctcccctgcggggggcctttctccgtgtcccccgcccgccccgtccacttcgggcgccatgaacgaccagtaccaccgggcagcccgggatggctacctggagctcctcaaggaggccacccgaaaggagctgaatgcccccgacgaggatggcatgacccccactctctgggctgcctaccatggcaacctcgagtcgctgcgtctcattgtgagccgcgggggtgacccggacaagtgtgacatctggggcaacacacccctgcatctggcagcttccaatggccacttgcactgcctgtccttcctggtgtccttcggagccaacatctggtgcctagacaacgactaccacacgccgctggacatggctgccatgaagggccacatggaatgcgtgcgctacctggactccatcgcggccaagcagagcagcctcaaccccaagctggtgggtaagctgaaggacaaggccttccgcgaggcggagcggcgcatccgcgagtgcgccaagctgcagcggaggcaccacgaacgcatggagcggcgataccggcgcgagctggccgagcgttccgacaccctcagcttctccagcctcacgtccagcaccctgagccgccggctgcagcatctggcgctgggcagccacctgccgtactctcaggccacgctgcacggcacggccaggggcaagaccaagatgcagaagaagctggagcggcgcaagcagggcggcgaaggcaccttcaaggtctccgaggatgggcgcaagagcgcccgctcgctctcgggcctgcagctgggcagcgacgtgatgttcgtgcgccagggcacctacgccaatcccaaggagtggggccgagccccgctccgggacatgttcctctcggacgaggacagcgtctcccgtgccacgctggcggccgagcctgcccactcggaggtcagcaccaactcaggccacgactccctgtttacccgccccggcctgggcaccatggtgttccgcagaaattacttgagcagtgggctgcacggactgggccgcgaggatgggggtctggatggggtgggagcgccgcggggtcggctgcagagctcccccagcctggacgatgacagcctgggcagtgccaacagcctgcaggaccgcagctgtggggaggagctgccctgggatgagctcgatttaggcttggacgaggacctggagcccgagactagcccgctggagaccttcctggcctctctgcacatgggggactttgccgccctcctgcggcaggagaagatcgacctcgaggctttgatgctgtgctctgacctcgacctccgcagcatcagcgtcccactggggccccgaaagaagatcttgggggccgtgaggaggcggcggcaggcgatggagcgcccgccggccctggaggacacagagctataaccgggggctcctctccccagaccaaaatgaattgcaagttgccacaacctatggtggggtctcgaggtcctcacagttgccagccctgcagcccccttccccaggagcaaggaccagttggggcgactcctttgaaagtctgtctgcaccttgaagctgagggtgtggcctggaggcaccagaggggcaagagaatgttccggaactccagttctgaggggtcttgaaggccctgagccacccattctgagcagccgtaaaggacatgtagacttgggggaggcctgccccagagggagggcaggggcatcggaactggatgagagtgtgggaggtggatgcgggagggtgcacctgtcccgggcgccgtggcctctcccacccctcccctgatggtcttgttctcttgtgctcaggccagagacttgctcacttcctgcattgttgtgaagggaagagtttgggctgcctcccctcctcccgtccaccccagaggggaagttcctcagccagactcttcagccaaatgccccaactttcagtctgtaccccatcccaagcatagccagctccccctccttcacctagtggtcaaggcccggagctggaaagccgggttggggtggggtgggggtactgacgcccttcccagctcatccaggggtggagcctggcctgtcttcctccaacctccccctttttcgttgtgcagcctggccccccagggaccccagagggccagggcgctagatgcaaggtgctagaccaatgggctgcagtattatagcccccaggcctggcaggcatgcgctgggctagagaaaggtgtccgccaacctcctcagtctcccaggcctgggacaggcagaacagggtgtggctgggtgtcaggcctggggtgggtaagtcctgcgatgtggacactggagaaagtggatcctctaaactgcagattgtccccaggtcaccagggctgtgtgcgtgtgcatgtttgtgtgcatgtatgcgtgtgtgcatgcatgtgtgtgtaagtatgtggtatgtgtgagcacgggtgtgtgcttgggtgtgtgtgtgttcttgcatacatgtgtacgtgtgtgtgcacgtgaacgcgtgcgtgtttgtgtgtgtgcatgcatgtgtgtgcatgtgtgtgtgtgcatgcatgtgtgtgtgtgtgcatgtgtgcgtgtgtgcacactcacgttgggtggtgtttggtaggtttccctccaggtctggtagggactgggctgttgcgtgattctgcgtggatcgggggtaagagagctcacctgtgtcccagccctctgatggtggtgagaccaggggaaaggccagctcagagggtggtcacagcatgtgtcctctgacgtatgcccccaaagctctccagccagactgaggtcacagatgtgggagagtccctgatgagcccgctgacacgtgtgcgcccctttgcaccccatgcagaggtgctctcctcctttctcagccatggccccccatccctgacctcagcttgggaagcagctcctgctgggagcatggcctcagcccccagcatctcctggggcccccatggctggggcaggggaaagagagccctcaaaggcctctttctggtctgtctgggggttcccattcccacacatgtgcccagagtagggggcatggaggagatggtccctgtcctactgcaggacactgagggcttggctgcctgccaccgccatctggagcccaccacagctctctccctgttctctgggcctgagcctggggccacccccaagtgccgacttgtttctcccagagccccaggtgctgccccttctctcctgttcctcgtccgtttactgccgcagcccctcctggttcttctggtgctggggtgcagcaggctctgtgctcccaccactgtaccccgaatccctcctgcaggctcattgccacttttgtagagaatgttctctatcagtatcgt

SEQ ID NO: 398 - DNA, 2990 bp, Homo sapiens
gtagggacttcggcacgtgtgtcattccccgggatttctgtagtaaccctgcttctggtgaacttgtctggccggcattcatttaaggcctaaggatgaaggcgagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaaaaggattgagagggaagaagaggaagaagaagaagcccttcctttagatatgatggatgaagatgacttacagttaatgaaggatttaggacaaagagtatcttttctaacaagagatctttcttctagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagagcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgttcgctggagcaccttctgaaggctctggagcactcaaaccagagttgagtcgaagatctgctactgaactttttgaggcatatagcatggcagaaatgacattcaatcctcctgttgaatctccaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgag

SEQ ID NO: 399 - DNA, 2560 bp, Homo sapiens
ttttgctgtctcctgccctggctctcttcctgtccatacaggcccattattcatgcttgcatttgctgtttgtttattaaaattccccagctcttcgttttaaaaatgccattgggatatatttccagtagagtgggtctctttcaactctgggtttccctggttcttcccaagtctgtacaaacaagaaaagttgggtcaagggaggatggaggctcccagctggtctgttctgcaaaggtctggagatgaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagc

SEQ ID NO: 400 - DNA, 2574 bp, Homo sapiens
atggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggcaatgaatattttgacttcagtgctgcttctatatgcaaaagaggaagaagctttttggcttctggttgctgtatgtgaacgaatgttgcctgattattttaatcgtcgaattattggtgccttggtggatcaggcagtctttgaagaacttatcaaggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggttctttgacaatgtcactaataaggatagtccattgccttcaaatgttcagcaaggttcaaatgtgagtgatgaaaaaaccagtcatactagagtggatattacagatttgattagagaatcaaatgagaaatatggtaatattcgctatgaagatatacatagtatgcgctgtcgaaataggttgtatgtgatacagaccctagaggaaacaacaaaacagaatgtgttgcgtgttgtatcacaagatgtgaaattgagccttcaagaattggatgaactttatgtcatctttaagaaagagctgtttttatcttgttattggtgtttgggttgcccagtattgaagcatcatgaccccagtctgccatatttggaacagtatcagattgactgccagcagttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttggagggagttggtacagtcagcctttgggaagaatccactgtgaacaaagcttaacacatggggcttcatcgctcatagaatatgttattttcaaagaagttcaagaattttcaagttgagcctttgaaaatcccataaattggttttagctaaacacttactagtagtgtctttaaattatttaatcaaccttgtcttttcaaggaaattaccacttaaagagatagttggtaaataaacatctatgccttttctcagaaatgatttgctgaactatgtccatattttacagcttagataatagtttatatggaaactattatacatctgctattgtgcaatgattgttaaattatactgaagtagctctagaaagacgcatgtatacaaggcactattgtacacactttgctgaatattttgtcagttgtatttacaaagaaaggtactttcttaagagcatatatgttattaatatttgatatgattttaaagtcagaatagtacagattgctgagtattatactttaggctagattaattaaaattgaatactgaaagagattttttgagttgcaaaaagtttataaatgcaaagcaaaaagaaaacatttattttctgagtctgcaggagaaacaaactaaacattatagttttatagctgctatcttgttaaccaaacaggttgttcataatattaaaaatcttacgtagttgtgttaaactgaaccagttcattataccttatgcattaaattaaatatgttataaggtggctttacttgtctttataaaaataaatatatctactaaacatg

SEQ ID NO: 401 - DNA, 3098 bp, Homo sapiens
aagcagcaacggctgctctgcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcagcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataataataataatgatgatactctaagaaaaaaatctcaacatacttcatttaatagctcgttaccaagtgtgaatgaagcaatatgtcataatagagtagccactggttgcataataatagagacctaaattctcaaatagggaaagaggttttaaaatcaaatttgaggccaggtgcagtggctcatgggcggaggagggcagattacttgaggctaggagttcaagaccagcctggccaacatggtgaaaccccatctctactgaaaatacaaaaattaggcatagtggtgcacgcctgcagtcccagctactcaggaggttgaggcagaagaatcgcttgaacccaggaagtggaggttgcagtgagccgagattgtgctgctgcactccagcctgggtgaaaaagacaggctgtgtctccaaaaagaaaaaaaaaagtcaaattcaaatatcatctggacatgtcacaatggatcgcggatccttatgagtgattttccccagtggcccctggggatgtgccactgtcactcagaagggcaaactaggcagggcccatacaacagcaggggtctgcaggttagacgttccctgccctgggacgctcacccctgggcaagaggctggaagttcacaccatccaaaatttatccttgttttttttctgatgctaattagcctctcccgattttatgacatcttgtgttgatctttttcaaaaactcattttcttttttttccttctcttttctccttcttgtagcacatatctttcgttaaagatcagatcaataaaatattttatttattcattaatttaacaaaaaaaacagagcatttagtttgtggcaaaaacactgagctttcgaatatgaatcatgtgctttaggtgggaattgtgaattctgaagatacagatgacagtgacgaatgccttctgtctcatgattgacagggaaaaggaaggttgaccatagcatcctagaaggctcatcaggtgatcattacctagcatccatgaagcacctgaaattatttgcaaaatgttacgctttggaccatttttccggggaaggagatccagaactttttaccagattttcaaagacatctgtgactcccaaaagttaacaatcactgatgtggttgttgtatccctcatccaaccccagaacactttctgtaatctgagttttttaatggcaagtggcctatatttagcacctgttctcatgttaaacagctctgaatgttagatattctttcttatcctggactggttctctctatctctggagtaatgcagtataaattggccatcagtaccctcctaaaatctgagatctgccaggcccctcttctaacaccaggttaggcatgcttggttatttccagtacttgtcagtcaacatgtttcaagacgctgtgttagacactagggatgcaaagatgaatgagataaggcctcaggcctcatggaaggtgagacagtaaagacattactcccataaaaatgtgaggagagagactcagttcagcaactgtttattctgtttattgagcacttacttggaccaagcactgtggtcttggtgttttacatagactgtctctaattctcacaactctgcaaaatatatatattcccattttataaaactacaaactgaggctcagagaaggtgtgacctcttgttgcttgaggcacagagttataaagtaacatatctggaatttgaaatcagatctgtttagggctaatgctgcatttttctacaacatcatgcctctagaaggtttaagctaggtaggctttcagccagcagacatgatggggagagccttctaataagagggaagagactgcttggaagcatgaagggaggtgtaagaaagataagtaagtcagtgtacttgcaacagaggcttgggatgaagggtgggtgaagttgacatcacgataaaaaaaaaaaaaaaaaaaag

SEQ ID NO: 402 - DNA, 2602 bp, Homo sapiens
aattactattccagtcatcaccctccctcctctctcttcctgcccccttatggtggggtggtggggggcactatccttctgtcacagcccaggcgcagaactgagaaaggaccctgacctccatctgcttgagtctctcacaactattcccagtgcccatccattttttggcatctataggtacacagagatttctcttgattcttctgttgtctccccttgccctgaatgtgcatttatggagccccagccatgcacccgacctgccagcccccattggtggaggggctgcctcctctacagctggctgttccctctcccctggagcacttctatcccaagtccccaggcctcctccctgcccctccaatgcatttatccctacatctggacacttacatgagtgaaaaggaatgtgattagtaattacggcaggaccacagctgtaaatcgggactcctctgggcaaaccaggagccaggtcactctcatcataaggcacagcttcctgccacattctttttctagaagctccaaccctccagatgcccagtcactgagtccaggggctcaggctcagcactactggcttgctttgttttcacagtttctcattgagtcctgtgggaattgggggaagtacttgtgtgtgtgtgttgtggggggataagtatttgggagcagcctagagtggcttctgctgtttcactgaagactgtctcttgcaggccaacccagtagagtcccctgagcccccagaatcaagcccagctttcttagtcctgcctttagggtgcaactgccagggtccagtgaataaaatccctgctccatgaggcttacattccaatggggtaagggagaaataataacacaataacagtattattattcagtgaattatttagtatattgggagtttgtaagtcacggtaaaatgaaaaagtagagcagaaaacgggggctgggggcaggttgcagcctcttcaaaatgaaagtggatggaaacaatggacccagaactacctgtcagataagtccctgcatagccacatggtgtgagatattatgagagattctagaacaaagtaatttggcaacaaatccgtaggtgtatgtagtctaaaacaaaaactttattgagtatttatccctttgtattgatagtgtatttttgcaactattatcttatcagataaagcaagtaaataatatatattttgtatattttgataagaatctagattttaggattagtgacaaggaaggctaattttaggatcccaaatttgactaagaacagggcactgttggaactgaatcaaacatattaatatgaagtcatgtctttatgaaacatgacattaaaaatattttgacttttttccactgaaacggcccaggagaaatgtcacctccacaatgcatcttaatgctaagattttggtttctagtgttagttttctcccaaagtgctgggattacaggcatgagccactgcgccctgcctcacttgaacttttgagtcttgcaattggaaatagatcaaaatggaatagttttccccttttcttggcctcaccccagatcaggcctagattatggagggccagtgaggtggaacgcttactgtgtgtttttgtttttgtttttgtttttagacaggggtcttgctctgtcacccaggctggagtgcagtggcgtgatcttagctcactgcaacctccatctcccgggttcaagcgtttctcctgcctcagcctcccaagtagctgggattacaggcacctgccaccacacctggctagtttttgtatttttagtagagacaacgtttcccaatgttgcccaggctggtctcgaactcctggcttcaagtgatctgcccgcctcggcctcccaaagtgctgggattgcaggcgtgagccaccgcctgtgttttaaatgaagagtttcagtttagctgatggcagcaaatagaagctgaaatttaaatacaagtaacattaagtaacatctccctctgttgcaactttgggttgacaaaggcaaggctcaggttaaagaactgataaaaacttggtcatgaggtgtgggtctcatcatgttgcttaaaaacaaaaagcccagcttccagagatgtgcatggtgttgattgtggcagagggtatgagaaagtggggcccactcttttctttggctaatgactcatttaaaaactcatttgtcacctaaaacatttattccaaaattgggatttttaaattaaatgctatttaaaacttcagaaaggaattaaaaacttgataattgaaacaggtgatatgtcaattcaccttttaaattcaaataatataattcagaataaatcataaaatttgggaagaatttggatttcttcaccaacactaaatagctattgcataagtgtgtgctgtaattgtaaacactggtgtattttacaaactggttttattggaatccatgtagtctgaaaattgtatgattctgtaaaaaagtttccacttgaactttctgagaatggtttaaaggtgaaataatctgatacacttctctgtcaataaaaaataaatcatgatat

SEQ ID NO: 403 - DNA, 2595 bp, Homo sapiens
acgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtaggcagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattc

SEQ ID NO: 404 - DNA, 3846 bp, Homo sapiens
cttttccggacctggccgagcaggaggcgccatcatggtgagctcgctttgcggcgttcggggctggataatccgctgccatccgccgtggttttgggctaggggcacgctggagggcggcagggggtctgcggctgcccggagggagcaattcccgatactggggacctactctgggggccaggaaagcagggatgggtcagtcatagcctaccgcccccacttagtagatgaccaagtggaggtactcggaggctgatatgactgggtttacaaagccaggaagtggcagagccaggattccgacccaggtggctggacccgcagccactcttagttatttggctttgctgcctttatctggacctgtcactttctagtatgaaaagtcgggttcgatgggggccgcggcgggtgagaggatcgagagccgaataactggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacagtaagtgctgcataagtggagctattaaatagttcttgtaattgtcaacacagtctgaaaaacttaagttgctcagaaaggcagcagggcggtaggagcctggcgaggcggctcacgcttgttatcctagcactttgggaggccgaggcgggaggattccttgcccaggagatcaagaccagcctggccaatattgtgagaccctgtctccactttaaaaacgatgttttaaaaagacactatttggtaagggttgttggattgactgatgctgtaggagaggtggttctagtagtattgctaggttctgaataaggattcgttttcatcattactgccattggtttgatatttttggttatccctccgggtatgggaaccagttttgataacattgttgcaaaatacaagttgtaaagaattgacctttttgtattaagttaatatgattgctgtgttacgatgtttcagggttctgtgtgccatgggctgaaggctttgtaaacagcccctttttacagagggatcagtggcagcccacaggtctcctggtggtgggcctgggatttgagctggtgtgttcagacctgggcttgtgtcccagctctcagtttcagaaataagtaataattggctatggttgggggtaattgggtccatggttgcctcttcacccccacagggagtggacatccgccataacaaggaccgaaaggttcggcgcaaggagcccaagagccaggatatctacctgaggctgttggtcaaggtgaggctgggccctgaggtctttgggaagggtcaccccaggtctgacttgcagatcctccattctagtgctggcaccaagctcctcccaggggcctgcagagcagtctcgggtctctggttctgttccagggtctcctgcatttgtattttcagcctctaggctgtgtacagctcgggagtggagccaggattttctaggtccttggccaggaaggacctgggccagctttctccctctaggtcggtgggttgggggaaagggataaagattattttagtccagatcatcatgtgtttgccccttcactggaaggctgcgggggagcaggctgtcccagcttctcactgtcttcccgtccctccagttatacaggtttctggccagaagaaccaactccacattcaaccaggttgtgttgaagaggttgtttatgagtcgcaccaaccggccgcctctgtccctttcccggatggtgagtggctggtccagagagcacggtagacctgggagccgctgggtcttgtctgtctggaagggaggcaggacttggagctctgggagcaaccagggcatcaagggtttgtctcagccagtcgcgagcgtagagcttggactgttggttggaactgagtgtccatgggcagtgggcaagtctcctggtcctcctctccttctctttgtgaggtggaggtgtcctggtggcttcaggagattgccccaagtcataactgagttttatgtcaaaggctctgctgagggaggccctattgaacagtctgcatttttttttttatctggagctttccccagctggacctgaggagaggcctgtggggtttaaggggtgtggtgtgagtggggggtcccgttagagggcacagctgccctggcctggggatgcctcaagcggggctgaatgtaaacaccagaacaacttacgacgtacatcctccccaccctaagatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtgctggtccatcctcagtcttgccaccgctggtgaggcaagcatcctgcctgtctgagtggctttgaggattggtgtgggtcgtctctggcatggttgatggtggggtcccctgggcaagcttcttctggggcaagttgtaaactgttagtgctggcccctagagccagacagcctgggctcaagtctagactcctttgtcacctctgcacaggtctttttttggcccagcttccttgctgtagtttctagcataacaccagggatgtggtggtgaaagttccggaagtgttgagaactgctgctgtcagcccagggtgctctgggtagtaaacgatagtgttggttaccagggctctgctgcgccaaggcagtggagggtgagtcctggcagcccctgggtgaccacgcaggggtctgacccgccagccttgtcctctccaccaggtatgtgcactgcgcgtgaccagccgggcccgcagccgcatcctcagggcagggggcaaggtcctcactttcgaccagctggccctggactcccctaagggctgtggcactgtcctgctctccggtgagtgatacgtggtcgacgggtttggactgagctgtgtggctactggcagccttcaccctcctggatctgggaggccagaagctgggcgccagatccctgtctcacccggttctccttccccttccctaggtcctcgcaagggccgagaggtgtaccggcatttcggcaaggccccaggaaccccgcacagccacaccaagtgagtatcaggcccccagccctgccctctccccagactcagcctgcagggccaggcctggccacacttgggctgcttctcctatccctcgtaccagccagccccaggccttctggaactctcagctgcctcatcctgcctgcttttcccttcaacactgcttggagctgtgttttccagggcctgagcaggcatctcctggggagcatgcagttcaccggcctttgccagcccaggctgggaccctccaggtggtggggcaggtgcttccatagcccctcctggctccttggcttcccactctgccaagcttttccagcagcattgactctcctggggctgaatgtgacaggcttgtggtgttcctgtgccactccacaatggcctcctttaagagggcccccctctcactccctcctctccccacagaccctacgtccgctccaagggccggaagttcgagcgtgccagaggccgacgggccagccgaggctacaaaaactaaccctggatcctactctcttattaaaaagatttttgctgac

SEQ ID NO: 405 - DNA, 3100 bp, Homo sapiens
attttaatctttattataaaattataacacaaagaagaatcctgaagaatgaccctaaagcttttgtcacaatagcattgtaatggaaatacaggtgtgttttcttttctttcttttttccttttttgagacagggtcttgctttgtcacccagggtggtgtgcagtggagctatcatggctcactgtagcctcgacctcctgggctcaagcaatcctcccacctcagcctattgggcagctgggactacaggcatgcataaccacatccagctaattttttgtagagatggggtttctccatgtattgcccaggctggtctcgaactccttggctcaagtgattctcccaccttagcctcccaaagtgctgggattacaagcatgagccaccacacctggcctatgtgtgttttatgattaaaaaagaaatacatacaattattgggacagaacaaaataaagagaaaaatacaaattacctgtaattcaactatccagagataattattttttacggactgaatgatgttctccaaaattcatatgttgaagccctagcccctaatgtgattaatatggtttggctgtgtccccacccaaatctcatcttgaattgtaactcccacaattcccatgtgttgtgggaagaaactaatgggaggtaattgaatcatggggacgggtctttcccatgctgttcttatgatagagaataagtctcacgagatctgatggctttaaaaaatgggagttttcctgtataagctctccctctctttgcctgctgccatccatgtaagacatgactttttcctccttgccttccaccatgattgtgaggcctcgccagccatgtggaactgtaagtccattaaatgtctttcttttgtaagttgcccagtctcaggtatgtctttatcagcagtgtgaaaatgaactaatacagtaaattggtaccagtagagtgggttgctgctgtaaatacccgaaaatgtgaaaacgactttggaactgggtaacaggcaggggttggaacagtttggagggctcagaagaagacaggaaaacgtgggacagtttggaacttcctagagacttgttgaatgactttgcccaaaatgctgatagcgatatagacaatgaagtccagcctgaggtggcttcagatggagatgaggaacttcttgggaactggagcaaaggtgactcttgttatgtttagcagcattttgcccctgggcattttgcccccatcctagagctttgtggaactttgaactcgagagagataattttgggtatctggcagaagaaatttctaagcagcaaagcattccagaggtgacctggttcaccacttgggtgctgttaaaggcattcagtttcaaaagggaaatggagaataaaagttcagaaaacttgcagcctgacaatgtgatagaaaagaaaatcccattttctgaggagaaattcaagctggctgcagaaatttgcataagtaatgaggagccaaatgttaatccccaagacaatggggaaaatgtctcaagggcatgtcagaggtcttcacagcagcccctctcatcacaggcccagaggccaaggaggaaaaagtggttttgtgggctgggcccagggtgcctcgctgtgtgcagtctagggacttggtgtcctgcatcccagctgctccagccatgactaaaggggccaaggtacagctcagattgttgcttcagagggtacaagcccccagccttggcatcttccatgtggtgttgagcctgtgtgtgcacagaagtcaagaattgaagtttgggaacctctgcctagatttcagaggatgtatggaaatgcctggatgcccaggcagaagtttgctgcaggggcagggctctcatggagaacccctatgagggcaatgcaaaagggaaatgtggggttggagtccccacacagatctctactgagacaccacctagtggagctgtgagaagagggtcatcactatcctccagaacccagaatgctagatccaccaacagcttacactgtttgcctgaaaaagccacagacactcaatgccagcctgttaaagcagctgggagggagtctgtacccttcaaagcctggatgtgagacatcgagttaaaggagatcatttggagctttaagatttgactaccccacaggatttcagacttgcatggggcttgtagcccctttgttttagccaatttctctcatttggaatggctgtatttacccaatgcctgaacccccactgtatctaggaagtaactaatttgcttttgattttataggctcataggctgaagggacttgctttgtctgagactgtggacttttgagttaatgctgaaatgagttatgactttggaggaatattagaaaggcgtgattggatttgaaatgtgaggacatgagatttggaaggggccaggggtggaatgatatggtttggctgtgtccccacccaaatctcatctctaattgtaacttccacaattcccatgtatgatgagaggaaacagtgggaggtaattgaatcacagggacgggtctttcccatattgttcttgtgatagtgaataagtctcatgagctctgaaggctttacaaatgagagtttcccttcacaagccctctctctccctctctttgcctgctgccatccatgtaagacatgatttgttcctccttgtcttccaccatgattgtgaggctccccaaccatgtggaagtgtaagcccaattaaacctctttcttttgtaaattgcccagtcttgggtatgtctttatcagcagcatgaaaacggactaatacagtgatagtatttgaaaaggggcctttgggaggtaaacaaggttaaacaaggtcatgaggaccctaatccaataggatttgtgcccttatgaaaacagggagagacaaaccagagctcattggctatctcttccatgttgggacacacaaagaagatggccatctccaagacagaaatgtgatcatgctggcaccttgaccctgaacttctagcctttggaactgtgaaaataaatttgttttttaagccac

SEQ ID NO: 406 - DNA, 3601 bp, Homo sapiens
acgcagccccatcccacacacacaggcccggtgactcaggggcccacgtgtgcaggacaccgggagctcacagggacagcgccccgggggatggaaggaactttgcctctctgtccctctctgtagggatggaaagaggagggcgatttctgggatggaagccatctgcctcctctcaactctcgctgcccaaccagaaagggaagaaaaacaggaagatgcgggacaggtgaggagctgggtgagcgccaccagcctgcagcccagcagggcagggcttggccaagcctggcgccagggacttcccccctacccccaccacaggcccctcgccaggtgagaggcaccgacagaatcccagacagatgccccagacaggatgcccggggcaacccccgccccttcccctgctaggggcccccaggacgcggggctccccctctccttttggccagccacagagtccagcggatctcccggccagggatgtcgtgggagaatcaggaagtcgaagccacacagccgagaaggggcagctggcgtctcggaggccgtcacgagctgtcactccgcgcccgccggacttgccgctcaattaccaacttcaacccagggccggccacggagcctcccgccgcccctaccccgcgcccctggcacccccggaccccggcgcccgcgtcacttactcctctgccgtcgccacctgtctgggtcccggtctcctccctgcctggccgcggcgcgtcctccccgtcctcgcagtcctcaggttctgcgcttcccccctccagcaacagccgcagcctcttctcttcgggagggacgtcgtcctcttccctcctgggccggccatccctgcctcggggcttgccagtggcttcggagctgccggaagggctggccatgactccgggggctctgcctgcacctggggaagaggaaggacccggcgcgagcggcctctcggcggagctggggcgtctgagcgagggctcggtgggtcagcgcggcgcggggctgggcatcccggcgggcgcgggctcctccgcgggccgctcctggctctctggcgccctctcctggccgcttgcgcgcaccgcggacacgccgggtactggcctgcccggctctcacctgcccaggcccaagcagtcgctgtcccctgcctgtggccaggcccgctctggccaagccctgcaccttctccccgccccagccaggttgcacccgatggtctccctgcccaaggaggagagaagagaaaggacgccccgagatggtggacatcggccacaaccaccttgtctttgctcttaccctgtgtcttccatgatttggaggtggtgggaaacccgaggctgctcaaaactcgtggagaattccgcctgcaggatgacatgaatgcaccttcccattgcctaccaacagatcttttttgagcatcactgtggaccaggcgtggtgatgggggaggggatattgtggagaacatgacaggcattgccttcacccagtggggctcagcgctgggtgggaaggcattgagaatggacgttgtcaattgggcaaaaggaggccaagaagaagtgctgggggcatgggaactgaaaaagacaggaggctcagcaggtcttggagctgggagagggacagcagcagcggctgttccaaaggaagcaacagctgagagaggcctcagagagttgttctcagcccagtggagggtgttcaggcagagggaacagcctgtgcaaaagcccagaggctgggaaagaagcagaaagaggactgtggggctggagcgtggtgggcaagaggagaaaggtgtggtgggcagacagattgcctgggaccgagccgtgcaggggcagaggagataggggatccttgcaggcctccagctggggctgaggcacagagacaatgcaggtggtcaaagggaggagacgtggagaagtattttggaggcatgccctgatgaatgagcccaggatgcacccttagtgtcagtgcggagctccttcctaggttgtgtgatgggctgaactggggggtattttctggacatcgaagtgctacacccagagtccaggacaggctaagtgagcaccagcagctcctggcccacctcaaaagcaggagagacaggggagactggggaggccagggcggaaggggaagccaggaaggcaggagaggccagggaagcagaggaggccagggaggcaggggaggcaggagaggctggggcggctgtgtcctttccatgattctgcccaggatcctaggccgctgtactccctgagcttccccaccccaagtgctggaaccatgttgcacaacggtctccccactaagctcctgatggcagcccctaccctgctgtgctccctatttcaacactaacagctctcacagtgggcagcacatagtaggtgctcaggaaacactggtgggagagcacgtgggtctgctcagcaccttcctctctcctccagctctccccatcatgaaataattctgataacgacacatggactttgagatcctcttctattacttgccatatgctaatccatctatacctcacagcagtcctgggggtgggtgctattaggatgcccattttacagaggaggagactgaggtataaagagggtaagtgacatacgcacactacaggggctggggccaagtgatcagagcactcaatccccaaaggcaaggtggatgcagttaccataaaagacagcagagtcaaagctgcaaccagcatagcctgactctcagagacctacggtgccagctgatcgtggctttcctagaagtgaaatagataagaagcctgccacatttttactggatctgtgtttgcagaagagttctaggtcaggtgagcagaagtctaatctgaatcataaaaacagagtcacagtccccagtcaattcccagacataagccagttcacagacccggattcccttgtctgaatgggaagccaggtcccctgcagaaaggacactgctccactgccacaaattaatactgtcaatctttctctcagcctgcctccaagggaatacacagccttttaccaggatgactgaacaggagaaaaggaactaatggacctgtgcaggatcactggacacaggctgtgaactggcactaggatgagactagggtctaccagtcagaataggcattttggaggtcaggtgaatgttggtgcaagttcatgtcatggtagatccattaggtcccccaatccatcctctggttatatacaaagcggcaatgctgagattcaaattcagggcatccaacatggtgaagccctgtctatactaaaaattcaaaaattaggtgggcatgatggcgcacacctgtagtcccagttactcgggtgcctgaggcaggagaatcacttgagcccaggaggtggaggttgcagtgagcggagatcatgacactgcactccagcctgggcaacagagtaagactctgtcttaaaaaaaaattaaaataaataaatgctatgcccagtattttccatgtactgtcttattatctcagtaaatcccatataaccttcct

SEQ ID NO: 407 - DNA, 2702 bp, Homo sapiens
cggaactatcgcctcttctacgcgtttattctctccctctcattcctgacggccttcatcttcgcctgtgtggtcacccacctgacgttgcgtgagttgtgggtgagggcagtggggagtggaaggggtcagccagcaagctcaagggtcagcaagcttcagcagtcactgtccctctgagcttgtcctctcctgtttctttctccccaggcgctcagggaagcaacttcctctccactctgaaggagacaccagcaagatatcctttgtcagctagaggacactccagtgggaactgaggtcccttcactgggtgggtgccctgcctcatcctctaatcagaagggaacagcgtacagctcacatgtgtcctccagaatccaacatgccagctcttctgttcacacccaggcaagagctgatcctaaatggggcattgtggggccgggggttcctcgtcttcaggggcctggaaaagagtatgtcccttaagatgccaagctccctggaccgtgtcgtgcccaaggctctttgtgattggaaccctcagttttctctgccgtccatcaccctgaccttgtctggctcttgagtggggtcctgacccttccgaggggcccaggaggtgatcctgctaagaagtggggactgggccacaggaaggttccaaaacttctcagctctctggggaaacagctccatggaaggataggtgagacaggccaggtgtggctgggaggctccccaccctccacccattgaagtccttaactgccctcaccgtgctggagttggtgatctgcttcttctccatctggtccattctgggcctctcagggtttcacacgtacctcgtcgcctccaacctgactactaatgaagacgtgagtaaacctggagccacccctcattctagggcagcgccctcaggaggaggcagggctgagggagcctggggcagccaagcacagtcctgactcacggactgctgggatagtgccttttaagcagccagatgcctcccagtcatctcagcttggccctggtgggtccgatgcaggcttctgacacctccacatgcttcattctctcagtgcaggctcccaaggtcccaggttgcttttctccacagccctgcaggaggcagtactcacaccacagcacgcatgatgtttggctggcacatgaccgcttacagaattctttcagttcccgtcatttctttgggtccttttgccaagcctgaggcagaaaggacagggatgttttttccccattcgatgactgagagacatgtcccatgtctgagaggtcacacagctgggaggggacagagccaaggttggtgcccagtcacaggtatgcgctccctcttccacactgcccctgtcagcagcaaagccgtgactattctcaaggtggcactggcctgtcctggctgcccctctcaatatgcacgcctgggggagacagggcacaggccagtgggctccattgaccttccctgcctgccaccctgcagactgccatcaacaagcatgtttgatgtgcccagtcctaggccagacctgacttctcctccccatcctccaaacactaaaaagtaaatgagagcatctgtttcagggcccaccatctgatacttaccagcaacccatcctccaacagaaaatacattcccagacctcatcctctcattcagggaaacaaaacttcacacatgacagggcgttgtgtgcctggtgatcagtgagaacagaaatgccatcagccagtatctcccgcagtagcttcttgggtgccagttctgcagcacattaccagaggttaaagagaaaggagtgtgtggccaaataagtgtagaaaactctaggttaaagtcaaggtattctttattgctaaactctccagtgccttccatagctgacttcacagagctagagaatctggcaagaattaatctaatgccctagcaatgtcatctgagaattagtattattttccctgttttccaaatgaggactcaggctcagcgaagtggtgatctgtccaggtaacgtagccagtgagtagcagggccggggctcacaggcaggtcagccctcaccctgtgcccctgcgctaccctccttcagaagtggctggccggagaagggaggagtcatccgaaacgtttcctctggatgcttctcttgggctctgctctgtcatctcctctttgggtcctcctgatctctgccaggggtcccccacattctcattgaatggcccacatgaaagacatgtcgccttctgtaaccagaattggtttcggaattgtccagttgtccccagcctctagacctgcctcctagaaaagtgaagcaaaaggaggtacttgacctaggcctccttcctgcttgcagatcaaaggctcgtggtccagcaagaggggcggtgaggcctctgtcaacccctacagccataaaagtattatcaccaactgctgtgctgtgctctgtggccccctacctcccaggtaagtgagcggggtgcggaagaggggtaacagggccatgcctggccagtgatcaaagtgttcctggatatcagccgacctccccctacaccctagatgccctccgtccactaccccctggagggcatttgtcatgtgacggaattccatggagaattgttatttaatcacgtgctcattgtag

SEQ ID NO: 408 - DNA, 3434 bp, Homo sapiens
tatgatttgtgcacagtgtgttatcatggagataaacatcatttaagacatcgcttttaccgaattactacaccgggaagtgagagggttctgttagagtctcgtaggaaatctaagaagattacagccagaggaatctttgcaggtgccagagtggtgcgaggagtggactggcagtgggaagatcaagatggaggaaatggacgtaggggaaaggtaacagaaatccaggactggagtgcatcaagcccacatagcgcagcatatgtcctctgggataatggtgctaagaacctttacagagttggctttgagggcatgtctgatctgaaatgtgtccaggatgccaagggaggttctttctacagagatcactgccctgtgctaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtggaccttcaatcctgctgttctcactaaagcgaacattgtccgaagtggagatgctgctcagggtgcagaaggaggcacctcgcagtttcaagtgggtgatcttgtacaagtttgttatgacctggaacgaattaaacttctacaaagaggacatggagaatgggctgaagcgatgcttccaactttaggtaaagttggccgagtacaacagatttattcagacagtgatttaaaggtggaagtttgtggaacatcttggacatacaatccagcagcagtttccaaggtggcatctgcaggatcagccattagcaatgcatctggtgaaagactctcacaactcctgaagaaattatttgaaacccaagaatctggtgacctcaatgaagaattagttaaggctgctgccaatggagatgttgctaaagtggaagatttgcttaaaagaccagatgtggatgtaaatgggcaatgtgctggccacacagctatgcaagctgctagtcagaatggacatgttgacattttgaagttacttttgaagcaaaacgtggatgtcgaagcagaggataaagatggtgatagagcagttcaccatgcagcttttggagatgaaggcgctgttatagaagtactacatcgaggtagtgctgatttgaatgctcgaaacaagcgccgacagacaccacttcatattgctgtcaataaaggtcatcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgtttcttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagag

SEQ ID NO: 409 - DNA, 2977 bp, Homo sapiens
ctggagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttattttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagctatgtctaaatgtccaatatctccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaat

SEQ ID NO: 410 - DNA, 2810 bp, Homo sapiens
cagagggcggatctgtggaaattctttgaagactgtgaagctctgtggaagtggctaacaaagttgcttacattcaaggtggagcatgccatagtcaagtcatgagctttgggaagtggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaaaggcatcagccaaagagaaggaaaggaaccggtcactggccttctgcacaccacggggtgctggcttgatgaaccctttgcacacctggcatcagtgctcactgtacgcttctcatcctgctcagtagacatcccagatttgtgggtgagaagtaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttcctaaagctgccgtaacaaatctccacaaactgggtggctgaaaacaatagaaatccattctctcaaagttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggttcagggttccctctcaacccaggatgatttcatctcaagatccttaactaattacatatgcaaagaccctatttccaaataaggttcccttctgaagtttcaggtaggtttgaatcttccgggacactgtcccacccggtacaggtgggcaggattgttcctcctcattccaccccatcagcacgtgctaccccatcagcatgtgccacttgcacgtgccatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacgggggcccagcagctggatggctgcagggatcaagtcttctctggggctggcacgtagaagagcatgtggctggtggacgggcatgcctggctcctcacctggcagtctcctgccctctaaccggctgtctcttgttcccctagtgccctcggctagcatgacccgcctgatgcggtcccgcacagcctctggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 411 - DNA, 3138 bp, Homo sapiens
cgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgtagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatgcctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaatactggggcttaaacaagcacattccaaattaagaaccaatgacctaagggaatgtctggttacctcctagttatacaagcaaaatctgcatagtatgtagtcttttttatttatttatttattttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagatggggtttcaccgtgttagccaggatggtctctatctcccgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttcaagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatg

SEQ ID NO: 412 - DNA, 2347 bp, Homo sapiens
ggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccgcctgctggtgctaatagggacagccacaggcctcttgcagactggcccaccctgcctactcccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttggaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatggtttttttaaggttaaaaaaaagtttaggattattataaatcaatatttataaataagcaacaatgtatttggaatttttgtttacctgattaaatatgtttttggtatgtgt

SEQ ID NO: 413 - DNA, 3469 bp, Homo sapiens
tatttgagacagagtctcgctctgtcgcccaggctggagtgtaatggcgcgatctcggctcactgcaacctccgcctcccgggttcaggcaattctcctgcctcagcctccccagtagctgggacaacaggcgtgtaccaccatgcccggctaattttgtatttttagtagagacagggtttcgccatgttggacaggctggtcttgaactcctgccctcaggagttcctcaggaggagttctcggcctctcagagtgctgggattacaggcatgagccacagcgccgggcctgctactgcacttttcaagaaatggctcaggacttctcatcttaaaccagaaacaacaaggaaacccattctgttgactttacagcttctgtgttgctcttcacagcccaagtttataaaagagacgcgttttccgccgtctgcatctcctcttctcacccctgctccccacaggaggccctgagcgcccagcagcccttggtcctgcatccccctccagacaactaaagggcctggctccctccaccctgcccggatccagctcccagtgcccgaatctatcccccctccccggatccatccccccctccccggatccattcccactgcctgaatctactctcccctgcccggctctattccccctacctggatccattccgttgcccatgcctggtcccttcaccggctctctcccctggggccgcaaacctacctgggcccccctctggcagaaaggggtcctctcagacccacaggtccaacggctaatcctggctctgcttcccctgggagccttctgcggctgcccccaccctgggctgggtgagtgacccccatcaccctggcagctgagcagtggggctccccactcgccccagctgcaggcggaccctggccctggaagctcactccggctctgtcgctgcagaatgaatggaacgcctactatgaggaggtggtgtacgtcctagaggagatcgagtacatgatccagaagctccctgagtgggccgcggatgggcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccggtgagaggcacgggcctgctggctgcagcagtccttactctgctttccaagcacacatgactgcacctcatgctgtgggtccactctgagtaacacagacaccccctgccccatggagcagtggtccttgcagaaacttacatgggggtaggggtggggaccacatgcacagaagacgtgtggggagtcccagaaggcttcctggagggggagaggtctaggctgagctctgtttgctgagtgcgcatcactggggaagtggtactccaagcagaggctgcagaaaaagcagctgtgggacgttcaggacacaaggaactgtactgggttcagccctctgatggggcagggcaatctgagttctggagagcaggcccagaggggagaagggccaccgctgctcggggtctggggcagaacccgtatctgcacctcgtgaccctagccagggctctgaccacctccatatcccacatctgtggccccagagatgtaggggggcccgagtagcagtgacacctggctgtgcaggacaagggcgtgatcagggagcacggaggttgccctcaacagacgtcctctagaaattccccaccagtcgccggtgaacatgatcagggccattgggtctgctcggtccagtgtctagaagtgagcagaccgcttgggaggactcactggtggcaaggtcacagccgatggcttctgctgaccagagagctcaggggtctgcaaaacgagatgcaactcctggggaaccttttggatttagtccagtctgggattctcacagacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctaattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgggtggtgggcctggggtgccctctgccagggtcctggggcccacagacctgggttcaaactgcagcttcactgttctctggctgtgtgaccttgggcaagtcactggatctttctgagctcctttcacctcgtctgtaagatcaggacagcagcatcacctgagggcactgaatgagcgatccttgcccagggccctgcacacaggcatgggggcggctgctgtcactctttgctcatgtggtgctgacagccacgcggtctgcaggaagagcaggagatggaggctaaggctctgcctccacctgctcctgtccttgtggctccaggctatacccaggcagggtcgggttgggggctggggcatcctgtgggcaggagactgaggccagtggctgggtcctggtgcaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccacatgggcccaggcctcaccattccaagtctccacccctttctagaccaataaagagacaaatacaattttctaactcagc

SEQ ID NO: 414 - DNA, 2347 bp, Homo sapiens
tttggcctctgtcctgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctgggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccaggtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctcc

SEQ ID NO: 415 - DNA, 3472 bp, Homo sapiens
gaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttttaaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgtt

SEQ ID NO: 416 - DNA, 2735 bp, Homo sapiens
agcgtttgtctcgttaatggagaacacagtcacaggatcaaaagggctaatttcaggataattctcctgaaatcctgctaatttcaggataattcactgcttccagaattttagagtactggtaaagaatgaagtgatcagccagcagctgtgcgtcatcttcacacactgctacgggccctaccccatccccaagctcacagaaatcaaacgggaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctcccagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcttttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtggaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccctggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 417 - DNA, 2954 bp, Homo sapiens
cctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggttccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggctattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacatagttgaatgcaagcaacccagaagaagtgttacagctggcagcgcagagaaggaaaaaaaagtttctccaagcaatggcttctgatgaatcttgcgttttttacaaattggagcagggacagatcatagatttctgattttatgtaaaattttgcctaatacattaaagcagtcacttttcc

SEQ ID NO: 418 - DNA, 2165 bp, Homo sapiens
acccaggagcttgccttgctcggctctggggccatgctgacatgctgacatcgccccctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctcgccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatgcaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcttacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctccgggagaataagcgagtcacaagtgccaccagcaaactgggggaggctcctgtgtgatgggcagccatggcctaggaccccaactccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaagggtagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcccgagtgggtgctggttgctgtgtcttgtctgtaaataaactcctatcatgccttt

SEQ ID NO: 419 - DNA, 2691 bp, Homo sapiens
gtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccaactcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctaacaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgcactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtccaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctc

SEQ ID NO: 420 - DNA, 2832 bp, Homo sapiens
agattctcgcgcggtaggccctgaggacccagcatggcggactcgggactgctgctaaagtggggttcctgccgttccacttggctgcgggtccgcaaggcccggccccagctcatcctcagccgccggccccgccgccggctcgggagcctgcgctggtgcggtcggcggcgcctacggcggcggttactgcaagcccaggcggccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccacccttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccgggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaataaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattaacaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcagaaagttcttcagggacctggttattagaatcaggataaaaataaggaaactggggccattacaatgtaccgagaaggaaggaagaaggccaacctgcaggatctcaagcataatggatacaagggctcgccacgggccttgcctgagccatgtgcagagctggggtccagcggtctgcttccttggagccagtgtggatggttacagcccatccatttggtgcagttgtacttggtctgttatattcaatcaaggtttaatagatagggctgggcatggtggctcatgcacacctgtaatcctagcactttgggaggctgaggcgggaggattgcttgagcctcggagttccaggctggagtacaccaactactccagcctgagcgacagagtaagaccttatctttt

SEQ ID NO: 421 - DNA, 2266 bp, Homo sapiens
atcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagagggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctgggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatggaggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgcctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagat

SEQ ID NO: 422 - DNA, 2759 bp, Homo sapiens
tgtagctgcccagactcgcgcacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccaggatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactataaaatataaaaacaagaaataatactcaaaccattgtaaagttgctgactaggttgggtcacatttgaaaaacaggccagtatggactagtggtggagggaaaactttaaaaataataaccacaatgctgctgaaacagactcacaacaactcttaatttaaacatgtgtggttgaatttatttccctgcatgcattgtgttttgtaactagttatgtggcatgcagcatttggaaaatttttcttatttaccagtgtttgatttgtgatttttaaaaattgatacctttaccattgcagaaaagaacttgtgctttcccagtggcgtatgtgtattgtttcaactgtattattataattatattttgcattgcaagattcttgatgttaaaccaatccttgtaaagtgtaaaaaggaaccctcctatcgtggaatgaaagattaagtatattaacacttttcagaatgatagtttctgtatttgatgttgctcagaaatgtctgagtatttgagtaagttttacatgacagtgggtactgaaattaagtcattttgttcagcactttaacgctttcttatagaattgtcttaaaacttctggatccttgagcaaatgattatagtctcctgactttcatgaggcttccattaggaacagaatgattgcatgttgtccccagaacactgccaccttgctatgcgaatgatgttctcagcagcacttctaagaaacactcttaaaagttatttattgaaaatttttcgtatgcttttaatattttaaagaattgacctaaggaaagcttatgattggacttattttccaaccagataacatttactctaagtacccagtttttataatttatatgaaatcagatttcaacacttactttgtcattttgtagatcattttttttaaatactgtgtaaaaactttttttacacctaagctgtgtttttgatactgatattttcctatgctgaatagttttcttactttcagggaaggtaagaaaatactttttttatatttgttacttatgtaacattcatatttttctcattttgatatttgtaacatactgtatgctttctacttgtaaatgtcaacaatagaattaaaatatttatttaaaat

SEQ ID NO: 423 - DNA, 3121 bp, Homo sapiens
atctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacaggcgataagctcacacctcaccctgcttgctccagtggttatggccagtgagaatgtgcggtgttgcattgcagaagaagctaggaaagctcatctggcctgctgttccagtgcttccaggggatccacgttcagaagctgactctgcaggcaagaccgacgttattttcctggtggctctgttcaaaaccacccaaagggtttgagaaatactttaagaggagtggaaggaacacaaactgagaaacatcaacagcaccacaaaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagagatctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagcgctcaccccaggcttccctgatgtctgtttacataccaaagttaaaaagctggaatgttaccaagactgctttcttctgcccatagacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgactcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccgcccctcaacaggcatgactctgcagagatgactcagtactgcccctcagcagggatgactcagtactgcccctcagcagggatgactcagcactgcccctcaacagggatgactcagcagggatgactcagcactgtcccttagcagtgatgacacagcaaggatgactcagcactgcccctcagcaaggatgactcagcactgccgctcaacagaaatgactcagggatggcttagtactgcccctcagcagggatgactcagcaccgcccctcaacagggatgactcagcactgcccctcaacagggatgactcagcagggatgactcagcactgtcccttagcagcgatgacacagcaaggatgactcagcactgcccctcaccaaggatgactcagcactgccgctcaacagacatgactcagggatggcttagtactgcccctcagcagggatgactcagcagggatgactcagcaccacccctcaacagggatgactcagcagggatgactcagcactgcccctcaacagggatgactgcagggatgactcagcactgcccctcagcagggatgactcagcactgcccctcagcagggatgactcagcagggatgactcagcaccgcccctcaacaggcatgactctgcagagatgactcagcactgcccctcagcagggatggctcagcagggatgactcagcattgcccctcaacagggatgactcagcagactcagcagggatgactcagcactgcccctcaacagacatgactcagcagggatgactcagcaccgcccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaac

SEQ ID NO: 424 - DNA, 2229 bp, Homo sapiens
ctctaaccctctccccttccgtctcggtacctcagctgtcctctcgccctccgttgggcttctccccagcggggccgggacccctctagtctccaccactcccctgggctctgtcagggctcccctgtccgtctttctgtcactacctcccagccagattgggacatcccactcacccgctccccagagctgtgtccaggaccctgctgaccccctcacccaccaggtctcccacctcccccatttccctctcttcactgggcaggggttccttctgtcactttaggtatgtaccaggcctctgctgtcagcctccttccgcgagacattccctcctgtcacagcccctccccagggttctcccacctccctacctcctcttctcagctggccccggatctcctccagttccctttgggtcaggacccgagcttccttgccatccccattctggcactccctcccagtgacagtctagtcccaccgtacattgtgtggtacattgtgtggccttctgctctcatctcattcttgggctgcactcttacagtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagtcgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattaccgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagctactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttc

SEQ ID NO: 425 - DNA, 3183 bp, Homo sapiens
attttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctacttcatcgatatggagactttaagaaacagcatagacttgtgattattggaacactgcttgcttggtatctctgctttcttattgtcttcatactgcctctggatgttagtacgacaatatacaaccggtgcaagcatgctgctgcaaattcaagccctcctgagaacagcaacattacaggattgtacgcaactgctaaccctgttccaagccagcatccttgtttcaagccatggagttacattcctgatggaatcatgccaattttctggagggtagtgtattggacgtcacaatttttaacatggattctcttaccttttatgcagtcatatgcaagatcaggagggttttccatcactggaaagatcaaaactgcactaattgagaatgcaatctactatggcacctatttgctgatttttggagcatttttaatttatgtagctgtaaacccacatttacatttagaatggaaccagcttcagacaattgggatagctgctgcaaatacatggggtctgtttcttcttgtgttgttgttggggtatggcttggtggaaattcctcgatcatactggaatggagcaaaaaggggttatctacttatgaaaacgtattttaaggcagccaaactgatgacagagaaagcagatgcagaagagaatttggaagatgccatggaggaggttcgtaaagtgaatgaaagcatcaagtataatcacccattgagaaaatgtgttgatacaatacttaaaaagtgccctacagagtatcaggaaaaaatgggtaggaacatggatgattatgaagattttgatgaaaagcatagtatctatccaagtgaaaaaagtctggtaaaactgcataaacaggtgatttattcagttcagagacaccgtcgaactcaagtacaatggcagattcttttggaacaagcattttatctagaagatgtagcaaaaaatgaaactagtgctactcatcagtttgttcacacctttcaatcgccagagccagaaaatcgatttatccaatatttttataatcctacatttgaatggtactgggaatgtcttttgcgaccatggttttacaagatacttgctgtggttctgtccatcttctctgtgattgttgtgtggtcagagtgcacattctttagcactactcctgtcttatccctctttgcggtcttcatacagctggcagaaaaaacatataattatatttatatcgagattgcctgcttcctttccatcttcttcctaagtatctgtgtttattctactgtgttcaggattcgtgtatttaactattattatttggcctcacatcaccagactgatgcttatagccttcttttcagtggcatgctattttgccgtttgacacctcctttatgtcttaatttcttgggtttgacccatatggattcatctatctctcacaagaatactcaaccaactgcttatacatctattatgggttccatgaaagttttatcctttattgcagatggattctatatatattatcctatgttggtggtaattctctgcattgctacttattttagtttgggaacccgttgtttgaatctgctcggtttccagcagtttatgggagatgatgatatgacatcagacttagttaatgaaggaaaagaattaatcagaaaagagaagagaaaaaggcaaaggcaagaagaaggtgaaaatcgaagaagagaatggaaagaacgttatggacacaatagagaagattccactaggaacagaaatattcatactgaccccaaagagtcaaacttctcagatgttaataccaaccgttctgcattcaaatataccagggctaataacaggactgaaagggaccggatagaacttctccaagatgcagaacctttggattttaatgcagaaacattcactgatgatcctcttgaatctgaatcaggaaggtatcagcctggtggacgatatctctcgatgtctcgcagtgacatatttaatgatgtttaaagtctgaaaaagtttgtgggaccactaaccaaggtcaacacatcagttcagtcttgatgaacatctgtgtaccctagaatttcctctatacacagtgaaaagtgtcaagataacaaaaaaggcactgagaattaattatatcttaggaataatagtttaatgtgcattgaatagagtatcacctttttcaacaagatttattacatatcatttcctaagcatctgccttagaaatacagttatagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcagaaagct

SEQ ID NO: 426 - DNA, 2310 bp, Homo sapiens
gcttcaatgccacggcctgaccggagtatccgccatggagtcgcagaaagaggcacgaacactccaggagcccgttgcgcggccttctggggcctcaagctctcagacgccgaacgacaaggagcggcgggagggcggcgcagtgccggcggcggctgccctgggcgcagaggcggacgacgacagtgcggacgggctgtgggagctgccggtggagccggccgagcggaggcctgagtgcacccgctgcagccggcctcagaaagtgtgtttgtgtccatttctcccagcgcaccctctgcatatctctacccacttgtacataattcagcatccagcagaggaaaacaaagtgttgcgtacagttcctctactagcagcatgcctcccccaggacaagtgtaaagtgaagatcggtcgtcgcttcagtgaagaaagagatcctgaactttcaactgtttgccggaagtctggtacattaatattatatccaggggctgaagctgctaatttggaagaatttatattagattctcctgtttatccttctacaatcatcatcattgatggtacatggagccaggctaaggacattttctataagaactccttgttccgacatcccaaacaggtgcaattaaaaactagcatttctagtcagtatgtaattcggatgcagccgactaatagatgcctttctacactggagtgtgcagctgttgctctttccatcttggagaaaaataattacatacaagagactttgcttcgccctcttcaagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaagaatgagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaagaagaggggattttgtttagtctttgtttatgacttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatac

SEQ ID NO: 427 - DNA, 3959 bp, Homo sapiens
ctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaaaagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacgtgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcagaatactctgaaacatatttcccagtggcccaaactctttattaggaaaatggacgaattgaatagcaaatggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatgtgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaagggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagtttt

SEQ ID NO: 428 - DNA, 2961 bp, Homo sapiens
accagaaagagctggcctctggggtctgcgctgccccttggggtccgctccaggcggcgcctcccctgcgccctttgtgtgcacgccgcaaacccctctgcagagctctacttttggcggcacagccttcggcggaaaagcgagtgaaaggaggcgcgcgggacaagcaggagactggaaggggggaaaaggcgaccgcactcactttggcaaggttccgtcatgttgcctttgggctgtcccgtggactcgtccctcaccccagcttccccgcccagccagggccagggcgaggggggacgggggaggagcggagccatcaagaccgacttggaaatggtgcttccggagctgcagggaaggggctcagaaactgtttgggttttgctgattggattttggggaaccagagggctagagaggggctaggggaaggcccgtgagcacggatgtatgaaaataatcatgttcccggggaataccaagaggggcgggggtgagggtgggaggtcggcaagtacatttttgtatttgaactttgtgagcaagttgtatcaaatccgacacttgagtttttcgactgtgctcgcttagagttgaggtttctacctcgtaacaggaccgaggacctacttcaaaagcaaagggcctgggaacaggggtgaacgaagggcacaattcaacaggggagagaaatcagccccgggtcttccgtgggtcctcttcttacctggtggcttttctaacaaagtatgagaaggtaaagtcccagtgatcgtccagccatgcttcgaccgagtcctgatccctctgctgctgcttctgctgctggggctgctgctgctgtcgctgctgcccgaagctggggccggcccgctccatggttggcaccgcgcgcctcggaggctctctggtactgcttttccaccccagctggggtccgtccctcagaagaacaggactcggcctcgagaccctcccccttcgtcctgctccagtcgggccggctttcgacaaagcggccggagcgccaggccagcctcctgccccgccccgccccgcgcggttctacgggcgcccaggtgtggtgggcggggccaggcgcagctgctgcgcccccccacccggggtccggcagtgttccgctctcgcaggctcttcagtcccctggttcccaggaggcggcggcggcggcggcggcagcgcccggcgagctctccggaagccaagtggcggcggctggaaggaggccgcgcggccgctggggtgcgctgtgtgccaagccgacttctggggagcgcgctaggtgactgggtgtgttctcagagtgccccagggagggaaggtcgcgatgtgggaagttttgcccgaaagtaagagatgatgagaccctgggcccttttcctggggcctgggagtgcaatgaccttcccgcctagcttttccctagccctacgcttgggtctgggaggagcgggaccgacctccttcagagcccagcccgctcagtgacttaaagcggtccagccacggaccactgcgggtggagagagctggggcgtgtgctagcaagagagatttgcaggtgtaggtgggtaacttgcaacaaagccatacccgtgcttaatgttaatgataacagcaataattataacttaagtgcctttaaccattgcctcaaacttcccttttgcataactggaaaaagatttacttgggaaagaaaaagcaaacaaataatttccaatgctttgtgcatgaagttagaaaacaagggcacctctgtacaattaggttaatccgagagcactggcgcaacccaggtgcagtcgagggcaaccagttatcccaattttaaattaatgcatcattttaattaaattggaattaacactccctcaaaagtatccattaaaaatggctcagcctttttgtccaatccctatcttgcttctttaaaaaaggaattggtgtcatcctttgctttgtctgcatccccatcttcctgtcatgcattggcagttttaatatggcattttgcaatgacctatattttttggtagaattaaatctggaattatgggttgcacaatgtgtgaatgacaccattagcagtgatataaaaaaaaaatgagttcgctgatatacttctgacaacttccttctaaatactcttggcaagaatttaaggcattattcactacatagaaacacatcattaaattgataatctgagaacttttaaaagtatcttctagtcccccaatgcaatggtttatctttccttcattgagtaattgaccttttgcgacttcagtttttctgaaactttactgctgtatgcaggtagccacaaccaaagaaaagcaatcaaagcagtagagtatgaactaatgggtgataaattatattggatttagaaatgagaattctctcctaatgtgttactatgatagtgattatagtgctcatggaatacagtcatgcgtcaccgaacaacaggatacattctgagaaatgtatccttaggcaatttcatccttctctgaacatcacagtgtactaacacaaaatagatggctcagcctactacacacttaggctattgctcctagaccacaaatctatacagcatattactgtactgaatactgtaggcaattgtaatgcaatgatatttgtgtgtctaaacatatctaaacatagaaaaggtacagtaaaaatatagtattatcttatgggactcatatatgtggtctgtcgttgactgaaaagtggcacattactgtggaaagtttctcctcagtacagttttttcttgtggaaatccatgcattcctcctaacaggagatcaatcgtaatttaaaactctgcttatctactaaagatgcagtgaatttggggcttgaattatttgcttttgttggatacttgattaaataaacacgtataatcatttc

SEQ ID NO: 429 - DNA, 2414 bp, Homo sapiens
agtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccttgccgaggcggcgctgcagcgagagaccggggtgccaggactgcttactcctcttccggacctggacggagtgttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagataccttttc

SEQ ID NO: 430 - DNA, 2699 bp, Homo sapiens
cttccgggcccgggtcggggctcgatggctacgtggaggcgggacggccgactgacaggcggccaaaggctgctgtgcgccgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgaggcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaagagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaag

SEQ ID NO: 431 - DNA, 3208 bp, Homo sapiens
ttatactcaattggatgctgctcaaatgagaaatgatgtcatagaggaagaccttgcaaaggaggttcaaaatggaagactgtttaggctcctagcaaaattgggaacaatcaatgaggggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttacaatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgtttttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagat

SEQ ID NO: 432 - DNA, 2396 bp, Homo sapiens
agcccaggcgctgctgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggtttttttgttgttgttggggtcaagttggtgagaggagagctcattgtttgaagaaaaaccaaaacattttatggctagtaatattatatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataacgctttatgttatacattaaatgtaaagacttgtgaatccatgtttgattgactttcatagtttcctgcattgaaataaaatcactatgaattct

SEQ ID NO: 433 - DNA, 2634 bp, Homo sapiens
atttttgttgttgacaactgtcagcttcgacctccttctcctcacaaccccgtctaaatggggtttgtaatcctccttcccacccactctcttcactccctggggcaagaatgttgactcctgctctccgtcacctgtcaggatccatcctcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaaaaaaaac

SEQ ID NO: 434 - DNA, 3116 bp, Homo sapiens
atctctctcgccccctctccctccgtcctgtcctcgccgctcccctcaccccgcctctctccccctcccccagcccctcctctcctcaccccacccggcctccctccctccctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgaccc

SEQ ID NO: 435 - DNA, 2095 bp, Homo sapiens
agaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgatcctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtagaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttg

SEQ ID NO: 436 - DNA, 2849 bp, Homo sapiens
aggtcttgagatgggcaacagagctgtaagatcccgccaagtacaccatgtgctcatgctagtgatgtcattaagctactagggcatagtgatgagatttttctgagatctaaccgtttccctccgctagctcctgaccccagcccagcaggctgtctcctcagtaacacatgggccttggtatctggcacccatcagccagcctcataggaaagaagccacctccgctgtatttgaagtttcactttttaaaaaaaaaatgtttcccacctttttatccttcacccactgtccttccacctgctcactcactcactctctcacccatcctgctccacacttctttggtagtaaatgacaccatcaccagcagtttacacccgcagttaacaggcatcgaactgaaagaatcagtgatgacgtttttgtgcatcttcgctgagtgggtaagtggcaacgctttgccaaatattaacgaagccaatcaaagagcagcgcagccacagtatcactgcacatatatatatagatatataaatataatataaatatttattttttgtagccaggtccttggtgcagtatttatactccacaatccaccttttaaaaaaaaggacaaaaagcaaaaagatgtgtgatgctgttaataatttaaaatgcagagccaaagccactgagcagcagctgacatggttgctggtttgtgtgtgaaaaacattttccccctcttctttccttaacctccttgttgcttaggatgaggagactctgtaatttaaagcagaggacgagaggaggaagaaacttccatgttaacatggcctactctcactcctttctaaacgagccacttttggcgtcagaagttgactggagagagataaacaaactcccagtcaaagcccctaaagcgacagtgcccagagttcttttattttttgctgcaaccaacgtaaacctgtaaaagaccaacagtgaagattagtgtattagtgaatgcatggaggccaatgctgccctaatgagacgtgataaaaagtccatcactcctctaagccaaaaggaaacaaaataaaaatgaccctttttactgtacaagggaagcctgtcttggtgtgtttgttgcttgactatcccaattcttgagtcctgggaggggtctgggaattgggaccttagcacatttggggaaaggaggggaatagagggaagagaaatcaaaggggctctcgcaaagttctggctaagaaggagagattggaagagaagcaaggtcctgaccccccccagatccccactcacccattgcatgtggcattccccactactggccggtgcttagaggcccataaaacctctcttcacctaatccacctggcagagccctcagagatgacgtcagccaacccagctggactggccttacttctgcctttttcacctgtatgttaaaaaacaaaaacaaaaaaaccctatccctgtgccccaaagctagggcatgtgcgatgcccaacagcctccactctgcaagctcatactgggccctgccctccatcgccccagacaggcccacagacgagggctggtctccttcacatttgtgtgggggtgggggcacgcttcctcttccttctctccctgtccccctttggggacatccctctctaggcctaggccatgtctcctggttcaggaacactctctcaggaggatctcgaagtgcccactctagtccgctccagtagctccactctggagcgagatggctggtaggtcagtccccatcctcctcccctcagcccccagcctccaggcctgctgtggaggtgagatcgccatgggtcatgactttgtgacttgagtcctgggcatcttctgtaatgatgcctctttcttttctcagatgttgcccacagtttagcaaaaagcttcgttcattttcaggtactccccaccccctaaagaattggctgcaacttgccagccagggggacatcaggagagaagaggaagtctgggttgggaggggcccaagttttgcaacagagtttccattgttcagctctgtgctttcttggattccctttccaagattaccaagatttcctccattaaaactcctgaggcaccccctgcccctgccccccactgctgtttgctgtacatagaggctaagtggggtggggtgggtgggtgtgcacatgtggtgtgtgtgtgtgtgtgtgaagaatgtatataggtaaaggggagtgtggtccagtggttccagaaaagggacagaacacagttctgtccctagcttgaccgctggctcgctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgttccctgttctgtttatgcggaaatggcagaaatgcttgagaaatgagaatgtgtaagtggattggaagtttatagtatgaaatttcaattttactttgtactgtacatctttttactttagaatttgcaataaagggttacgtcaatcttg

SEQ ID NO: 437 - DNA, 2440 bp, Homo sapiens
tagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaaagagagaaagtt

SEQ ID NO: 438 - DNA, 3329 bp, Homo sapiens
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaactgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggagaacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccataatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatattt

SEQ ID NO: 439 - DNA, 2662 bp, Homo sapiens
ctgggcttggagcatgacccccattatagacttggaaatcagggggcagagaagtgaaatgccttccaaaacattcatagcaattaagtcataggatgatagaggaattgcaatgttccaggacttacaatgttgctgtgtggatgttactctttttttaaaaaacagcttttacgaattacatatgcacaatcaagtgcagaccatggctacctctggctagactgccactgctaggggaagaaaagacatccatacccattgcttatgattgctgctgctgctgttgtctccaaagaagaaaatggattctattttctacccttatctggttgaggatgcttaaaaaccaaaagatggagatattttaaagttgaagcagatcctttccttagtagcgttaaactggaatgcctaaaacataaactaacaccctgttttttttctcctggatttcactggtgcctgagtaagcgaatatgctgtgctgttttcctggacactcagaatcaaacaggccttccaccccatcccatcatgttgaattacaaagtattttgagcatcgtttggtttgtttctttccgcccatacctgtgtagggcagcggtagcagtcttcaacaatgcatcctcttggacaatgcattgtaatatctctctttcaaattctgtttcacatagtcatttctcatgttctgttggagacccccaaaaaattcattccacactgtcatccctttgtcctaaccagaacaactcgatcgtgtcgaagaaggcatgaaccatatcaaccaagacatgaaggaggctgagaaaaatttaaaagatttagggaaatgctgtggccttttcatatgtccttgtaacaagtaggtactgggtaccagctctaatctgtggcgtccagttttctttcttttttttttttttcttttttaatgtcaaagtgaatgtctgaagttttgtctttttttctttgtccttttccatctgcttcattctgtggggataaaatacttgtgtttaatcagaacaactggaacgcattgaggaagggatggaccaaatcaataaggacatgaaagaagcagaaaaggatttgacggacctaggaaaattctgcgggctttgtgtgtgtccctgtaacaagtaggtgctgcctgcctgcctgaagctttgatttcccaaggcccatctccaagccttgacaagctcattcctgccaagctcataggcaggatgagcatgtggcatgcagaacagatcaataccgtctccaatgcattcatctcatagcatagatgatattagcaggagttactgttgatgcattaaaaatcaggcatactacagtgaaagcttcactgtcagcaacttttattgatgaacgtttcaacattttccagaaagtgtaccttgagacagaggctagcctcaagaaagaggcacccagggaacttccttttccccaaccccaagagtcaaaattacagatttagaaaaggctgcgggtaagtttggaagatgagaaacacatatgcgaaggtttgattttttccaaaataaaagagacaggtaatttggcccagggaaggattctataaattagagaatatgacagagattctccctttctactgcccaccagttgccaaattttgtcaatagatgctgccactgcacccaacacagaggcaatgagctcttcagcaagaagtgctcaagccttactcaaattggacccatccctcccaaatttttctccttggaagatctacccgtacactggctgaaatgttgaaatgtgtagattttgcatgcacaacatcacaaaacattcaactgttctcaaggttctgcaacgctttttttggaatgtagcagaaatgtgacatgtggttataaaggtttgcaatggaaggaacctaaaactgagggttctggaagattgtctcatttgactagtggtggaaaaagaaatgcatgagtggattgcccaacatgcatttggaaaattaaactccttatccaatctccctcacccctcccacttcccccttctaaaagaagactttttcctaaaagctctcctgatcctagcttttagaatagaaattgacgtcatttttagcagattatatgaccattcacatcctttaaactttgaggctgatttaaaatatcccacttcctgtttaggagggggaggggctcatattgcaaaaaaattaaaaaattttgctttttaaagagtgatctacagtaaagcctgattaactggaatctagctaactggaaacctcagctgcatgctcttgctcccttccatttttagcaaaaaagaaacaaagaaaaaaaatcacatcagaaatgtaaaatggtttttcttccagggtagtttgcattgtctcacttagtctccatcctcctgcaacttccacatctatgaggaccaaacaataagagttgatcttcacagaaaaggccatcaagcaatcagtataaatgataaccaaggaaagattcaatcaggtcttctaccttaagactttcaggcaggaaagtggctcaggagtctagcaaagatattcactcatcatccatgaaacaaaactttcctccatggccccactgttcattaagaaagtcatataattcatc

SEQ ID NO: 440 - DNA, 3442 bp, Homo sapiens
ctgttctcccaatactcagtgagaaaacaaccacaggaaatctgggaatgtgcagctagccccgcttaattgatctaagcagccagggccggcaggggagctttcacgtacacagcctctattcctggcttgcaggactgtttacctaaggggcaaagaagtccacctgcgaaagacaccatgttgctactacagccttagcaacagcagtagcccggttttcattgttgttgtttacagtcatgagagccatactcctttaagaaaacaccaaactcctttccctcattcctggccccaatcagtaatcaccaagactgtcagctgcctgcagttatcgggaagagcagcctggggaaagttaaaggagcacagatggacagttgctttctgcatgcaagtggccagctaggatccggggggcatcaagccatgatttttatttctgtgctggatgcattagcagctgtgacttggaaggttttatcctgaaggagtggaattgctgcagacgtcttggggttttggtgagcagtagatatttggggacattgtgctgttattggagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccagtaacaaagaacgaacggcaggtgatgaagccactatacgacaggtaccggctggtcaaacagatcctctcccgagctaacaccatacccatcattgaagaagaggaggggtcagaagacgatagcaatgtgaagccagacttcatggtcactctgaaaaccgatttcagtgcgcgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggccggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagccatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaagg

SEQ ID NO: 441 - DNA, 2629 bp, Homo sapiens
acacactctgctacattgaaactgctccctgaatcttttcctccggtaaattgtgcttcctgggaaactaagggtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggtgttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattacaagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcag

SEQ ID NO: 442 - DNA, 1958 bp, Homo sapiens
ctacttcattctacggccgagaccggaggatgttccctgctcaggaggaggccgacaggaccgtgtttgttgggaatttagaggcccgagttcgggaagagattctgtacgagctgttccttcagtttcttataggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgtccaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcattttgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatattttt

SEQ ID NO: 443 - DNA, 2085 bp, Homo sapiens
taatttgttgactctgtagcatgtcaagaagagtagttttttgagatctggcaagaatattttagagatacatattcttttctaagtatgttatcaccctgtggtgttgagcatatcgtcccaaaaacctgcttcagcaagcagttcttggccaggcatggtggctcacacctgtaatcccagcactttgggaggccgaggcaggtggatcacgaggtcaggagttcaagaccagcctggccaagatggtgaaaccccatctctgctgaaaatacaaaaattagccgggcgtggaggtgggcgcctgtcagctactcgtgaggctgaggcagagagttgcttgagctcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatacccacaggttggaccatctttcttatgggttgcacaatgaatttatattttaaattagattaagtagaatgtgaagtacatttcagatttactagttttctttccattgttcattttgggttgcctcagattcagtgtatattttaaaatattggttacataataggtactcaatgaaatggtttatagtagaatatctaagctagcactttattttaaaaagtaacttattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccag

SEQ ID NO: 444 - DNA, 2166 bp, Homo sapiens
ttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgaggactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccatagatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttctt

SEQ ID NO: 445 - DNA, 2585 bp, Homo sapiens
ggccttttttttttttttttccattttgaacaacttttattatacgtttagtgttctctatacaaaagaaatcagtttttttacagtgattcaaaaaaaattcagaataatttggccttttcattgctcatgcagtcagtttataagtccatgtattagacggccctccatggcccagaagtcttccctgctgaaggtcgtgtgtgacaccctcagatacgcatctgtcactgacaaagttggttaatgcaaaataactcgcaaaaaaggaaagaacatgatgtgagaggggttaaaacaaggtctggcatggagttaaatgtttaaccaatggaaaaaagatcagaccaatttgtgtgtgtgtggatatgtaggaagggatggagacgctgggaaaaaaaattccccacgggaaagaacaaattggaatggtgggggatatgggtgtgtggtgggggcggggcaggaggtcctccggggtccagcatgggtcgggagtgggagcaggacagaaggtggccacgtcacaggcgactgatgctcagctcaaggggagtgtgaagaggttggcaaagagctggggagccgggcagagggacaacactgactgaggacattgcagttgggaatcagaaaaaaaggggcagctcaggggcatctgatctgcctcatttttgaaaaagaaacagagtaatgtacaaaattctggatatcttctcccagagttttgtgtttattgcttcactgaagtctttacatctgttgaactccagcccagcaaatcccagggtggcagcttgcatgggccctgctgcctctctgcaccctgtggccatgggcagaatggaccgagatgccctcacttctgaggaatacagcacactgaaggcccgatgtgttacaaagcaagagacaccattctacggggtacggtctagggttcacagtaacaaacaccaatcagctatcctattccactggcccagatctgcccttaattgcatgactgggtgaaccacacacaggctgatcacagacagactgatcttggtctcagaaacaatcctgtttgtctttcattttgggaggcatgtgggggatgtgggagaggcagtaaagaggtatgagagggtgaaccagaaggacagatcttaatacctctgtttcaaaggaggcagctgtggtgagatgaaagaacactgactggacaaggagtcagaaggcccaagttcaagccctaaccttaccttagtttaccagctatgtgatcttgagcaaaaatcccttcacttctgtggatttgcatatccttgtctgtacgatagatcatttcaatgagatcagctctgggattccttcacatgccgaaatccgattctgtcctaagctagatgccttgtacctatttccattctcctcattatggaacacccatttaatactagtgtgctgataggaggaacagcagcttcaggtgaggcctgagacactgtttggtggacgcttgtggctctcctggatggttctcctttctctctgatccttctctgaatgtgtctcaggaaggcccattattagtaaggaagggaaagaaaggacacttccctgggcttgggctgtgcaggctggggacagccacaaagtctggcttggactcacatggggtagcccctgtctaggttaaggaatgctaggagatggtcaagggagggcactggtctgactctgcccggctcgcctatgcctcccagggccttggtctcctcttgacatatcaagctctttgtttcattgttttgaggcctctctatttttcctttttaaaatcagggccctcctccatgctactccttggccaccacgcagagctcaagcaggatcctttgccaactaacggtgtagatgcaaccgcaaccatgggcttttgtgtgtttggctggggctggccggagtggtgactgggcaggaggtcactctgcaccaaggtgtcatgagtggggagcggtgccttgtgccggcctcccaggaacctgctggccactgagaagggattctctggcactagccccagccgacggaaagcccgagaggcttcctctcctcagagagttagcaaagcagcctcacaaagacagacaaaaatgtgctatgtccctgctccctccatcaaacgggctgtttgtgatgccctaagacttggccctgctccagcacagggcgccagaaagagcccgctgcccgtgccattgcttgggcaaagtttcccactccttcagctcagatgctctctctaggtgctgccaacaggaattacctaaacagggcccaaccctggtggcctttcccactcctctaaggtgcgttcctcatccacacagagccctttgcatcttatctcacgcaacttggatgtggactaaccctctccaagacaatgttggaatctggatcgctatcccttggaagcactgcttggcaacagggttgtggtctgctgtatgtatgtgagcatgcgtgggcactgggtgtggcaggggagcttggaggagggccctgattttaaaaaggaaaaatagagaggcctc

SEQ ID NO: 446 - DNA, 2434 bp, Homo sapiens
aaaagaagttttgccatttgtagctctctcacaggtagcttaagcgagggggttgtgttgcatgtgcttagaaaggccaggttcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctctgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatcctttt

SEQ ID NO: 447 - DNA, 2050 bp, Homo sapiens
agcatcagtactgggattgggaactgcaagaatatgaaatgtaaatctttattgatttatatccttccttaccttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctccccttccgccatctccactggacataagccaatgcctgctctcttctcaccacattcacctggacaaatctgaactaattccttgagacttcaaattagcccttctgagcaagtgggcaggttctgaaacctgtgtgttttgtagcctaatgaattgatggaatgcacatgaacccatcttcacagcatgtgaaagaaccaacctgcctggcagaggtgcagaaatttccagaggactggcctagctataaacaccagcaacatctgcaacacaaaagcccttgaacttctaggcaaggactcatgctaacctagcagtactccagattgagaacgcagatggacaggtgtctcttgagcctgtgttccaagatgtctgtggaaaggattgcaactgtcatcctttggcacactcagtggaacctgtgtgagctacatgttctgctgcattatgggaactcatcaaagggccagattgacatcttgccagaaaaaccagtgttttgaggagcaaaagttttgtgtacttcagtaattgtcacatgtgtcttccacctccttgacatttatttgttaatcatatgatcatttttttttcactttcctttttttctttctcagaagtacttctggggctttgattgcattatttctcttttaatgtatcatttcagtgttggaaagaaaaatctggatctttatgtggggacctattttacatgtagatagttattcagtagatagtaaattatttctcttaagagatatttccttttatttctgtacaataatatgtatgaactcagttactaggggactgtattgtgacattatcaacctttattgctatttaaaaatgatagtttgtagaactgaagatttccattgatgtgaagcacaatttaatgaataagttaaaatattaaactgttgtgatgtcaag

SEQ ID NO: 448 - DNA, 2998 bp, Homo sapiens
ggagtagttctcccgggcgcctagcgggatcgccagcgcggcagtgggggcttccgcggctgcaagccagcgggtcctgtgagggcgagcggaggcggagaaagggcgcgggagtgagagagggtgagtcagccactgtctatgcaataaagggaggcctcaccgcgggatagggctgaattcagaagtgcggcccgtgccgcagtctgttccaggacgcggcttgtcttagcgtcagcgagggaaggttgaggaggagccagagcctggtcctgcagcctttctcgccgtcagcgcccgtcgccatctccaccatgcagtcccgggaagacgtcccgcgctctcgccgcctcgccagtccccgtggtgggaggcggcccaagaggatttccaagccctcggtttcggcctttttcacgggtccagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacatcctagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgtcaggccttttgcagtttgactctggctttatttgcctttgtgctcgtgtttatccttcctaccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtttgtaaaattattttggttttcttctacaaaggaaaaaattggatttatatatataaggttactgcataatgatttcattttgataatgtgcagaatggcctcataagctcacagaaagt

SEQ ID NO: 449 - DNA, 2021 bp, Homo sapiens
gcgcgcgccgagggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctaagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgt

SEQ ID NO: 450 - DNA, 2229 bp, Homo sapiens
ctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcgaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtgactgaaaactcctgaggcatttcctggactagaatgggtagtgaagacccatgtcagctatcagaggactcctgaaacctggagagctacctgctgtataaaggctggcctgagggcatttgctgaacacagagaaacccaggagaggagatcagcagttttctttcactctacttgatctgtcagatttacccacagaaagccagtcaggatcccttaagagtctttaggcccagaatggagtcctcagggctgcaggggactgtggtgctaacaattaaactgttcaagactttaaagagttgaaggggactaatgggtatccctagcatggcctcctagatgggaattaactggcaactcctactgtgccattcccagtatgtgtgcttccctttagcctcccatagaattggctgaaacaccctaccaccgttttctgtttccccactaccacacctgtgttatgggtgtcagcctgtgagtccttgaacccttccagagggctcccaagggagggtgatcactgcccttccataaaaggctgaggaaagccaagtgagaagattcaattaatttgggcaagttatttaacatctgaacctgtttttctcttcattgtttattacttaccttgtccaaaaaggtcataaagggtagggctttttctgttccacctctgtactatatttctccccaacaaatatctgcccctgaggacctcaataaaggtttggtcaagtg

SEQ ID NO: 451 - DNA, 2194 bp, Homo sapiens
caactaagctattatatgcaggacagtctgctgctagctgcttctaagctacagaccatatatatgtatatatgtacatatcctctccctgcccctcttgctctttatatatatatgcatatacctataatatatgcatatttagataggcttttatatgtatattgtatatatgtacatatatacatttattttttgagacagggtcttgctctgtctcccatgctggagtgcagtggtatgatcacggcccactgcagccatgacctcccaggcttgagggatcctcccagctcagcctcccaagtaggtgggactacgggcatgcgccaccacatctggctaatttttgaattttttttgtagagatggggtttcaccatgttgcccggttctcaaactcctaggctcgagtaatccacccaactttgctcccaaagtggtgggattataggtgtgagccaccgcaaccagcccatatatgcatatttaatatacatgtgtagcatatacatacacatatacacatctatgcatataaattaacaatatgtatatatgtgcataaattcacatatattttctgtataaagacagcaagagaggcaggcggagaaagaatcagttgcagtctggaggaatatacgtgtgttacatggtttccctgcctttaaattctctgttaatctgtattccttgtaaagtagatgacagcatgtatcttggcctacatgtttctaaagacaaacctctaagctcttgaagttctgccatggtgtatcatagtacattgaagtcagaaagcccattagaggaggaggatgcctggctagaatagtgttcttgagtttttccatgtgtattgtctcaggtaggaagatgacaagtcctactttgttcttgtgtgattccccatcattcagtctgtggaggctgagcttgttaatggtggtgaacacgagtttcgttctttgccaggagtgcccaccagtgcccataacgccctcccggaatgtgccgggcagtatgtttagggtaagactgactaacgacccaacactgacaacggccttagcacaaacccaaaaggctctgctagagctcagaggcagccacgagattgggagagctggatgacggtttgctaagagaattcaagctgtcagtcctcctgtgtatcctttggattctgttatgctgttgcttgtagagggaaaaagttcatgtgtcatttatatacaagtgcccatttgacattgagtgagtcacatttattttaccctatatgaacacaaaatctttgttttaaaatcagattctagaactttaaaagggttcttatgtattgttctgaagtaactcagtggctcttggtgagcccgccccacctggcctgttgggtgaccctcttcctgccccctcaccggttctgctccttgttcctctctctgcgccttggctccccttcccagagcccttcctcttggtcttgccaaatcctgcccatcctttgagaaacgcttatgcccatggctgtcttaccccttcctgctttgctgtggtatccattagtctgttctcgcgctgctaataaagacatacaaaagactgggtaatttataaaggaaagaggtttaatggactcacatttccacatggctggggaggcctcacaatcatggtggaagatgaaggaagagcaaagggactttttatgtggcggcaggaaagagagcttgtgcagggaaactcccatttataaaactgtcagatctcatgagacttattcactaccatgggaacagtatgggggaaactgcccccatgattcaattatctccacctggccctgcccttgacacgtgggggttattacaattcaaggtgagatttgggtggggacacagccaaaatatatctggcatatgcaatctgatcaccccttccaaacttctctcttaaaaatgcaacattctgacagcatgtggaggcttggatggaaacacggtaaaaattacaacattgtttctcacacttttgcaccaaagtgatacaaatcgcagagctgaggcaactggtgtttctgcgagaatggaatggaatgtggttgaaattttgtgttgttttttaaatatttgcaactatttgtcattcttccataaaaatcagaattcatggttgtgtacataaaagt

SEQ ID NO: 452 - DNA, 2569 bp, Homo sapiens
acgcccagcgcgggcccggcccctagcaccgccggccggccccgaggtccgggacgccggcgacgcgtgaaccacgccctcagccgccttgccagcgcccccagccgcgcgccccagcaccatgcggccgccctgcgcacggagccccagggtcagctgcgggctcccaggcctaggcgcccatgacccctacgccaaccgccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacggccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgt

SEQ ID NO: 453 - DNA, 2275 bp, Homo sapiens
tatgtctttcagagatcttgtgggtatcacatcaatcttgacaaattttctaccctccaagtcatgatcctaagaacagcttgcctcccatttctccggtttgtgctattatgaaggccttattgtttcagccttcttcaatcttgagggttgttgtcactgtatgggtggttcagaaataagtaggtcctgttactatgaagggggtcacagcttttgttggcatagctaaactttgtggctcatggaacagtatgaatgcagaatgtagctttctccacttgtggactgctttgcatagctgccagaggcctccagagaagaccttcagggctttgtggtctttatctgtagcacggatactaaaatttgtgggttcataggtcagctggatacagggcattttttgtgacaatttctggcattttttgaacaagacaaaattcttttacgaggtatattgcattgtacttggtacggctgagcgaagtctgttgcccagctcttgcaatgcagacacatgccctgatatccagaattctgtaggataacatcacagattgtaatgctatcaggtgaaattataattttatagaattactttatttataggcagtggaggagacagaataatgtaactgcaactcatgtcttttttttctttttttttctttttttttgaggcagagcctcgccctgttgcccaggctggagtgcagtggcataatcttggctcacggcaacctctgcctcccaggttcaaacgattctcctgcctcagcctcctgagtagctgggactacaggcacatgccaccacacccagctaatttttgtatttttagtagagatggggtttcaccatgttggccaggctggtctcgaactcctgaccttgtgatctgctggcctcagcctcccaaagtcctgggattacaggtgagccaccacgtgcagcgtaatgcatgtcttttaaaagggcatccacaatgatccagtcactacgtatatgatgaatatgcagatacaggaattatcaggacttccataatgatgaatattgtattgttgaggccattgtcagaggaaataatctaaaggttttgtgaattcctgtactcattctgggctgttctcctcaaggtcattcctgcattaacaggaggaagatgatagggagaagggagatctcagttcagtgatgtggcctttgtgaccagccagccacttaatcaggtggaaatggccttagtgccacatcaatatttgctaccgtggaggctagttttcccacttagggcatgagaagaattggtgtagtcagtatagagttgccaaacctgttttccaaaaataatggtaaatctatatttttcttttgaactgcatttttttaattattattattatttattttgagacggagtcttgctctgttgcccaggctggatggagtgcagtggcacgatctcggctcactgcaagctctgcctcctgggttcacaccattcttctgcctcagcctcccaagtagctgggactacaggtgcccgccaccatacccagctaattttttgtatctttactagagatggggtttcaccatgttaactaggatggtctcgatctcctgacctcgtgatccgcctgccttggcctcccaaagtgctgcgattataggcatgagccaccgtgcccaaccttttttttttttttgagacagagtctcactgtcagccaggctggagtgcagtggcatgaccttggctcattgcaacctctacctcctaggttcaagcaattctcctggctcagcctcccatgtaggtgggactggaagcatgtgccaccatgcccggccaagttttgtatttttagtagagacggagttttgccatgttggccaggctgatcttggactcctgacctcaggtgatatgcctgcctcagcctcccagagtggtgggaatacaggtgtgagccactgctgccagtctgaagtatattttaaagctgtgatgagttataaatgacattcagtaagctatgcatatttaagctgtagcatgtgataaatcttgagtttcatataatcccatgaaaccattaacatagtcacaataatgaacctaacacctttatatttacctggaacctttttataaaggctttctttctgttctccagacaaccaatgatttactttgctgtacagtagagtactttccattttctggaatgttagatgagtgatgtaataaagtgtttcctcttat

SEQ ID NO: 454 - DNA, 2376 bp, Homo sapiens
aaaaaagacgcggccaaggcccgctccgtccacgcttcccgccggcccggcaaggggttccggagaacggcttgggggggcgagaaccatgggcgggggaaatggaagacagagggaactgaagcacgggggtcttcgatgagcagtgcggatgttcgactccaaacatcaaagccaacgagaggttcaggttactcctccttgaccccaaacatccagtgagtggagactggcctgttcacagagtaaaatatgtcgtctctaattcggcaaagacggtgatgactgtatatatgcaggccaattccgctctccaagagattctaactcagtcacagtttgaaccactactgaaccactgctgttaggaagctacaacccaaaagaaaagccccacagatgctgagagctggtgatcctcaggataaaacaaaggaaccagaaccacatccactgatcggatttgcctggggaggaggggtgctctctcctttgatcttctcttctggaagagatggaccaaaagcctctccagcaataatccgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaagtcatcttgtatttatagatgctaatgaatttcaatgctttctatctttacacttagatattaagttctttgtgaaattctgtaataaaattctacttcatt

SEQ ID NO: 455 - DNA, 2063 bp, Homo sapiens
ctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggtcgaatcaagtggcatccttaatgtcctaatcaaactcttggaagtggttcagccctgcctccaggcagccaaggagcaaaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgt

SEQ ID NO: 456 - DNA, 2300 bp, Homo sapiens
ctgattatgcatgggctggagctgcctcctctaacctgttcttctccgagccgggcagccggcggtcctcagccgcccacagaacaggagccgaaacaaccgttctcgaaggctacagcgtttatttttctcttttggggggttttggcggttgtttcaggggctcgccaactggcccctttaattaaaagcttcaataaaaggcgatcgcgccaggaatgcacccgctcctcttcgcgcaggatttgcatatttttttaatgccctaatttccttgatgtatgtaaatgtagccggacgtagagggagacagggagctgacgtcaatggacgtgacctcgcagctaaaccttgaacgtgaagccgggatgggggaaaacacggagcggcagccggcggagctcgagagcgcgggcggcggcggcagtagccgagcccaggccggggtgccaagggaccagtgccggccccgggggaggacaagccgccgccttctttctgcaccgcgcggctctcagactcgccagccttccggccgcacacgcagactcttgccctgagcttccagccccaccacacacacgttcttttgcttccctcagaaaagcaacactccccaaaacaacaaaccaaaatcaacagataaaacagatgttttagaccaatgctcgggtagcttatcagaaagaagactctgaccacggaacatatatattttttggcttctctccacaagaagaggagcgagagaccacagacaacagcaaatcactcctaaaacacgataactacaagtgctccctgtagggagaggtaaatcgcccagccgactggtgaagtcttctggtttcgacgccgaaagaagcctgtttgtgtgctgcggccgtgctgtgactctggatcttgtctttcagccggcgcctcggttcctgcccagctggatttggggggcagcattgcctggcgcagggagatcaaatgagactgcaaagaagcataaaatgaatagacaatccaaccaaccaaagaccgggggcagcagcaggccagcaagacggcatcttctccttcccagcctagaagccctgtgaaatcgaggatcttccccctaaaacacatacacacaagatatgtgcaatcaagctgccaccgcttggtaaaaagctcatggtgcctaaccaaaaaggatcaggaacagatccttgaatcagctgtcacttctatagaatgggatttttttttccttcctccttaacctgcgctggaaattgccgttggctttatacatctctatagagagaggctaaagagtcttgcgtgagaaagaagcaatttacaatgcaaatagaggcctgtgaagggacggatgctgctgctcactcgtaacagcttgctgcaccttaatagctggttttattttctgatattaatagatgaattgttggctaacgctgccggagattacttgctgaagggaaaagaaaagttcggaataaactctgaaggcaacagatctcgtttggatgttttagccgcgcacacacacaaacagaaaccaggtcatatttacataaaaggaggaatcttaagcgcggcaagtatcctggacgaccactcttcggtactgccagaaaggatcaggacctggagtctggcaagaggaagacagaggcctgtgtgggaagcgagttgttatctttggttatctagctgtatgagtgtattggtcttcataaagctagataaccgaaagtaaaaactccttcaagatcgccggggagcgtgtgagaatgaaagactacagccgagagacagtaaaaaccagaaaggtcaggaatacttattgaatctaactttgtttttgttttgtttttttccttatgattaaaggtgggatgagagaaaattaaatgacacacacatgctaaaatatcaaggttccagatatgtcttgagaggggttgttgcagctgcaaaggagaagtgtatagtgataatgagtaaagatgcatgtgcagtttgttctattttaaggcaaaagttatatcagggatttttttcttagaaaggtgttgcagagatgtctggtacctagtttaaaaatgattccataatatgtagacttgggcagttcctttgtgaggcacctccctctcaaaatttgaagattgtgcttggaaattactttacatgtatttgggctgtatgtcaatttgtacgaaattagactttcagaaaagtttatactggaaggttaataatttgtatctactgaggacttagagctagcaggcaaaatg

SEQ ID NO: 457 - DNA, 2394 bp, Homo sapiens
tattctaggtttgctgccacaaacactagggtaaaagcaaaacagaagcctctcattagtaactcacatacagaccacttaatgggttgtactaagagtgcagagcctggaaccgagacgcctcaggttaatctctctgatctgagggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacaggccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgt

SEQ ID NO: 458 - DNA, 2792 bp, Homo sapiens
cacttcttaaagcgcctgggccacctcttggctgtgtgaccttgagagagtcttaacccccctctgagccaagttttcccttgtgtcaagtgggagaactcactctcatctcagaattgctgcaggcattaaatgtatagggcttgggatccgaatggaaatgatgtattaacgatattttgagggtggagctattaatttagcccctactgtctgccaggcacggtgtttggctcctcggtgcctctctgtccctcagtttccatttctgtaaaaagggggtaagtcctgcctcacactgggaggatgagtgaggccacgtcagtggttgatgtcgaccctggccctaggcccattgatatgactggtcatgtgtctgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgacaaacctcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggtatcagtctctttattggatgtgagggccaaaagggactgtaactcctgtctcaggaatggggatagatgggaggttcttgaagccccaggcgaagctggtacctctggctacagcttgctctctgagacctggggcttcactcggatcacgccctcctgggcacaggtcacagctaggactccatcctgacgccacagccgcccatggaccagcccccgagagccacctgtgggtgaggtgaagggtgatgatggcctgcttcagaacagccaaatacactttttttttttttcctgaaacagagtcccactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatgtggagactctttctcccttgctggctttgggcccaagtttgatgtttatgaggatgattgctggtttctcttacacatagcagagctcactcagttctcacagtagccaaatgaagcagttatgtgttgtcctgttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatc

SEQ ID NO: 459 - DNA, 2135 bp, Homo sapiens
ctcttttaaattgctcttaaggatgtaacaaagagtgcgtgggatgccctgagggcaggcattcgacttctggagcagcagcttaacttctgaaattcctccgaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgtgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacgaggcctcccccgagtactcagagtggcccagacccctctcctcagggggctagcaggcttcagctctcatttgaaagggccgatatcaagcagagttgtgctgaggccagaaacccccacgggcaggtcctcccagggctgggagtgggcatgccgtggggccggcgctgccaggacaggagggtggccacgagctccagctccacaatgccaggccgaccctgccgtggggctggggctgggacttgctgtgctctgttggcagcagctgttcctcaggggtttccaggctcttggagatcagggacactcatttctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggtcagacattgccctttttccccagcctcaagcacaggggacacagggtgggctaggccagagcgccacctcctcagagaggcccctgggcccccactgagcatgatgagcctgggtgaggggaggcgcctgctgcggttgccccgggtggaggccgcatgtccggtgtcccttggtcattgctggtcttcgcctgggggcgggctggtcaggagaccgattgggtaacactcctgatttcggcttctctgaaacatgagaggctgcagtgctggagccactgcccagggtccctacctgcacccctgcctggcttgtcacatgctctgtgtccagcctggtcatgcctgtccttttccccacctccccaccgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 460 - DNA, 2288 bp, Homo sapiens
taaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaatactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcctgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaacctctgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttccctttt

SEQ ID NO: 461 - DNA, 3287 bp, Homo sapiens
gttttgaggttgcactgttgccccaggacatcgtatgagtagagggttaaccaccttagccaagagtaatttggtctggtgagttctccaccttcaggacaaaagcatttcagaaccatcctaacaatagtgttcccataagtaaccagacactgtttgtatccatagcaacatggctccatgagccctgcttccgaggagcagctgcccttcctgggcactgtcaagagttgttcttctctgacatccacacccttctttacctggcacataccccagcccaggcaccaggcatccagggccttctatggctgtccggatgcattccttcacagctggaatgtggttggcttgttgacttctgttcccagcagagtgaacagtgggcactataagccagtaggcactcaattgatgattcttcaatgaaataattgatgccacttttaggtcagtttttcttgtacgttacaccttctgttgttcaacagagccccacaatatcccagaacttggaggtcttatctcggggtttctcagatgttggagtacccaggtatcacctgctgagccagtttccctggcctcacctgcaggggctctgagtcagtaaatctggggcaggcccagtactttgcatgtgagcacagacccaggtgtttctgaacctggtggtccagggactgctgcaggaaggagccaataggactgcatgccttacaggcagtgggtctcatccatccctatctatggcactgactacaggccatgtccaggccacatgggcacatgctattataattattttgtgcgatggatgagttacagaactggagccctaagacctgagttctagtttcagctctgccagttgctggctgattgaaactgaacaagccacctgccttccctgagactgtctcttctcctgtgaaattagggcattagaatacatgaagacccctttatgtccttaataacctgtaagtttaagaacctagggaatctccatgctggtggctgcggttatatccccttatcctcaactcgtgaagaaagagtcaaaaatggcagcagggttgtgtcaactgctctcctcagcagctatcataagggaattgcctttgtcattttccccagccatcaccacactcccacacggccaccatcacctaaaccatctggcagtgggggttacctcctaaatctaagacgcagagacccaccgcaggcctttctttctggctgccctccactcccacccagaggctcagttttgctgggctgcacacctccgaggactcagttctttgtgtttcatgttgtttcatatccactagtgttacagaaactgctgcaaaccagggaccaaaagtccataggttctaattctagctgtgacactagtgagatgagtgactgctggcaagttactttatctatctgacctcacctcccatgtacaaaattgggtctgtatgcacatttgtggttctaaatcctggagtccaaatcagagttctttgtgcaaaatatacgtagctaggtcctaacctcggagatcctgactcagtctagggaaaggcgcagatcttggggagaaaacaactctctagaagagtctcgccttcagtgagtgacaagatctctcctgtctctcggttcacaatgttaccctaactaatccatcctctgatgtcacctgctaacaacttcccctgtggcatcaaaccagtagcccatttgcagctagtacaaacacttctttacatttaagttttgtttacgagatttagcctacaatcatagaggctgccagctgggtttcaaatgtgtatgttccattgctaataggaaaaactgcatctattagaaaaattctctctgggagctgagcacagaggcaggccttgtattgcaaacatttgaaaagccgtaagcaggtattctggactgtgttttagatcacctgagaacatttcttgaacactagtatttgcttagagtgacaaacctattaagtggttctttcaggtaagtttgcatccaagcaatgtcgtctgaatcgcaggaggaagccaggagttgtgtctggctttctggccatacaaatggcatatgggaaagtcattgtatattattaatatcctttgatgtatattattatgactttctcacggtagtaatgttgttggtttttattaatgttatttttatagcaatgctaatattatgagctaaaagtttctgagcatctgctgggtgccaaaaattcttataaatgctttacatgcattagctcctaacaacactttgaagtaattcttattgtccttacttgacatatacaggaataaagacctgaccattagaccgagcgtggtggctcacgcctgtaatcccaacactttgggaggccgaggcaggcggatcacctgaggtcaggagtttgagaccagcctggccaccatggtgagaccccgtctctactaaaaacacacaaaaaattagccgggcgtggtggtgggtacttgtaatctcagctacccgggaggctaatgcaggagaatcgcttgaacccaggaggcggaggttgcagtgagccaagatcgcgccattgcactccagcctgggcaacaagagcaaaactctttcaaataaacaaacaaaacctaagcatttgaggggtttggcctgggcagtggagcttgtgagctatatgagctggaatctgagtcaaggctgggctggtgaaaggagttcactcaagttcccaaggtattctgccctccaggactctgaatcacctgggaggagaaggaattgtggcgggcctaacaccttttctttcccaaacaccaagagcaggttctttctgttacatccattgaggtcacattcttgaagtgcattttgagaaagtcattattttcgctacagcagggactgatgtatcagtctattagaattcagaaaaaagtaagcaaacaaaaaacgtgttggaattattctcttctagcattttgaaaggtacaatggttaatgttaactatagccaccatgatgtattgaagaccaggtcttattctttttatctaactgtacatttgtacccattaacctaatgctcatagcatcaagaaaagatcaatatttaaggtgacaaatatcccaattatgctgatttgattatatgaatgtgttgaattatcatatgtactcccaaaatatgcacatctaagatgtatcaataaaaataaagacaaaaattaaagcttttacagtag

SEQ ID NO: 462 - DNA, 2299 bp, Homo sapiens
atctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaagctcgtacgagaggtcaacgtatccaaaacgtgaatgtcaaatcagcacaacaggaagcatcagcagatgttgctactcctaagatgccaaggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagc

SEQ ID NO: 463 - DNA, 2942 bp, Homo sapiens
atttatttggaaccgttggataagaagtgctcgggctctcgctcagacttagggagctgcctcgaggtgatgaatgacaccccctggcaccagctacccttctcagaccccagtccagcccgctcccgacgtcgactacgattccgctacctcggctggcagcgaggttggggtgagccccagctgcaggcgcgtctgggctgcgccgctgcaaacgagttgcgcaccttgggcggctccgcacctgcacccgcacccgcggggctcagccccgaaggctgcagcttcgggggaggcgcggtcgccgaggtccagctggtggggcgagagacgtcgcccctcggaggatgctctcggaacttgggagaggaaggagggaagagaagaggggaaaggggccgtcgatgtttttgatgtctgtgctttaatggaggccaccaatattgagaagacggggttggccgaggcagcccgcacgctgctgcttgcgagcgctcgagtcaaagctagggccaaccgcggcttgtccgggtgccctaagggggcggacacttggtttagcaccgggacacagaatagccaccggggtaggaagatgcgttcactttgcttacctgttggcaagagggacatacaaaaataacgtaacgtgacatcgttgacaacggtagctctttgattacacaaaagccaattttaccttcccgcaaaagccagttgacgcctttggaacttttatttgcggcattttggcgccctctggctgtgtttggatcgctttcatgctcgcctgcgtcccagccaagaaaaaatcgatggagctgcaggttgtcctcaggatggttctgccctcaggacctgggcgtgaattcagggacagggtggccctccagaaccggagtgacaaactgtaaccatacttagggaggcagacgtcaaaggcaagtacatctgtattcaactgggtaaagccatgtgaagacgtgcctgcctccctgttaccttccaccatgattgtaagcttcctgaggcctccccagccatgcctgctgtatagcctgcagaacagtttcagtcgatttgattataaagcaaaggtttgggaagaaagactcatattcctcctgagatgcaacctcaagtcttaggaaaagaaagttttgaactcaggttccgggaatgtggaagaggaagctcttaaagggcaagtagactttgcaacatgctcgttttcaggattctcctcctttgtcctcaaccctgcccagtgttcccctaactccacctaagccactccataaagttaggtcccattcctctattccttcactactaatgacagctaatagagctaaacagaataccacaataagccagaagctgccttttttttattattattattattcattgcccaatttgtagaactctctgaattcaattaaagtttggcaaagcctgtgcaaatgaaaccaagtacctattttttgctcatcataaacccaaaagttttctagagaactaactgaaagagattttcaccaaatctttttatttttttaatctagagaatacaattgagaaccaaatcaataaatatcctcaactgttacctttgttataagggaactacgatgaaccgtgcttgccccacatttaccctagcagcaactatgctttttctatctctggccttaccctgccttcctgcctccagagtctgagatggagaaaggcaaagtcagatggaggatagagctgggcagggagttgctgccagcaacaattggagttgctggtttgctttcaacactgaccccactttattggccatgagttaaggcagtcaaatgggcatctaggaaacatgaccaagatctgcattagggaagcaaagcagattaaaaggcacaattgctggccaggcatggtggctcacacctctaatcctagtgagaggtgaagccagttggacttcctgggtcgagtggggtggggtcttggagaaattttctatctagctagaggattataaatgcaccaatcagctctgtgtctagctaaaggtttgtaaacgcaccaatcagcactctgtaaaaacgcaccaatcaatgctctgtgtctagctgaaggtttgtaaatgcaccaatcagcactccgtaaaacggactgatcagtgctttgtaaaatggaccaatcagcaggatgtaggcagggccaaataagggaaaaaaagctggcacccaagccaacaggggcaacctgcttgagtccctttccacattgtggaagctttgttccttcactcttcatgataaatcttgctgctgctcactctttgggtccgcactacctttatgagctgtaacactcaccacgagggtctgtggcttcattccttaagttagcaagaccacgaacccacagggaggaacaaacaactccgggcacaccacctttaagagctataacactcactgcgaaggtctgtggcttcactcctgtagtcagcaaaaccacaaacccaccggaaggaagaaactccagacacatctaaacatctgaaggaacaaactctggacacaccatctttaagaactgtaacactcaccgtgagggtccgtggcttcattcttgaagtcagggagaccaagaacccaccggaaggaacaaactccggacacactagcacttacaggaggcccaggtgggaagatcacttgaggccaggagtttgagaccagcctgggcaacgtagtcagaccccatctctacaaaaaaatttaaaaaattagccgagcatggtggcaagtgccagtaatcccagctactcttggaggctgaggcaggaagagcccttgagcccaggagctggaggctgcagtgaactatgatcaaaccactgtagtccagcctgagtgacagagtgagaccctgcctct

SEQ ID NO: 464 - DNA, 3100 bp, Homo sapiens
acttctctttcaaagatggactggggaaagacattaagttcggagcagcccaaggctgcggatctagcctttctccctccggtctccagacccacgcaggttaaggcagccaagcagagacagcggagccccggtgcgtggttcaggcctggtcaacaggtaggagggccagactgggggccaggcacagaggagggcaggcccgcccgcaccggcgtccagggtcccgggttccgggtcccgggactggaggaggtcgccggcagcccgcccttccagaggcttgagattgggtggacgagacctgaagatcctctcggtctggaccccgactttcgatctgcttagagacctaagccgcgagcctttgcccacacggagaaacgtactatctaatatctaacaaccctgtactgcagtgtctggaggttgcgggaaggagacagtgtctccctttgggaaaactactgaggacttctgtatatcctacttcttctggactccataagttacaggaccgaaggaaactgagaaatagagaaaaggtgccgcttgcccctttaactccagaaaagggtggctgcagatggagcagcttggactttattttttacgttgcgggaagcccgccggcagcggcttatgccaattgattttcccagctcccagccctggatgtctagctatctccaggacagtttgtttttttctttttctgtctttctttctttccttcaatgtatcagaagacctgaagctcgctgcccgcgagtttcctccgagttcccagttgctgagacaaaggaaaacccactcccttggaggagcatgaccttttcctgtaattcttcctactgctgttgttgagctccttggatcctggctcctggacaccatcatcaagaagactttatggatgggctgtccacccactgagagaagaggagcatcagctacagtttctctctagattgccttcttcattttgagtaatgactgtcagcagggtcagattaaacacaaaacaactggacaattgcttggaggactaaactataagggcactaacatgtcaatagtaggctaacacatccatggaaaatatatttaccagctcttctctcagggaggattctgtgtggggttggaagtaatgatttgttaaattccttaggggtagaaagtagggcataatcagaatatagaggaatatgctgtttgacttcagggtttctgtttttcttactaggatatataaaacagggactctagctagattgtttatgaccacagagggtaggctgagtgctcccatgatcttcctgcttggttcttgcccatacagaggtcagcctttcctctaataaagattgaacaagtagtggtctgagggagacaccaattcattaccctacatgtctcttctctgcactccagggctttgataataaagacactggcagactatctatcttccatttctataatgtgagcccttagggagtcttcgttcacttgggggtgagggtcattgctcacagagtagttcaagtcaaatggaacttgaactctttgcctatgggcctggtggtcagactctgtgttgagttcattagattattggagacacaaggtagagctggatgcttcaaaaatatttggctaaaggatgacattgctggttatttgtagataaagccatgatggaacctgcttggaatcatgaaatatggaactggtggtcatgtttaaaaatacaactaatagttaagtacctactggacactgtagagacttaggggctagacagacatggttcctgcccccttggagcttacactgtagcttccccttaggtatgaagaacagtggctacaactaacaaatggccacaaagatataattgagccagtgttccaattattagggtaattcctatttccttaatcattcctattgaccatgttctataagcctgcattctataaatggcgtatgaccatgggctgtttccccccagcaagttgtacaaagttctgtggtaccagggaaagggcttaaggttagcagggcctctgcggaaggacatatgaagtgacttgggttaggaaacaggaagggataggattcaagaacagctattgcttctgttctatataggaaactgcagcgtgaaaaatgctgggctgggaattttgagacctgggttttagtttgtgttctaatactaacaagctatgtgactgtgggtaagtcatttcacattccatttggatgcctcttgagtgactccaggcctctccagctctaaaacattaagatcaggccctacgctacagctggccagtgtgtaattcttctgtttctatgctgttaggtcaaatagatcttcaatagttacttgattgttattactttttttctgaagtgggtgttttatcaatgttttaggatacagtgagtctgcttctcccctttggagttaggaaggttgtaggaatatacactgtagagcatatgggagctttatcccctccttttttccctgctacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtcccagggtaaccaactacagacagatgccccattctactcaagcaacttttagagtgccttgagatacacatcagataattatgcagggccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttg

SEQ ID NO: 465 - DNA, 3125 bp, Homo sapiens
ggagaaagaggcggaggcagtggcggccgcgaggggagggggagtcccgtctgactgagacggcaggcctgggcgggcgggcgggggtgccgcgaagggcggagcgccgggctggggatgagctaagcgggctcagagcgccgcggcattcagcccctcgtgtcccgctaccgcgcgtgggggattccggcgccgctctccgagctcgatccgctgctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttaccagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaag

SEQ ID NO: 466 - DNA, 2856 bp, Homo sapiens
gtgtcaggacttttagaccataagttgcttgaaagtcgagaatggcagacatagggttgtggtgttgccagtccactgcaggtgctccagcccgcggcgcggcctgcgctgctgtctttgaggctgtagcacaagcatgagctcgggccccctccctgtgcaccggagacccagccaggtccagccggtctgtccatggtgccccaccagcagcatcgtgctgggcagtgccgcctgcagagtcatggagccttagttactgagcaggtgcacgtggggggcttggaaggccccactgcattaccatgccagctatcacacaccccgtgccagaggactgcatgtgacacggcttgattacgtggcactcgctgctgcaaagcaaagtcagatgtcatcatggaaactcaagcaccagtctttttctctgaattggaatatagctgtaagaatgtggtatgattctgttcctaaatgtgaattgattattatgttgaaacaggtaaaaaccccaaaattttcttgtcccgtgttcctgtgtctctttcgaagtgtgtcaccttaggtcactgtgtggacacagcaagggtggaggacgctaacttggcctttgcagtgatggtggggtgggacaggtgttctggggcacgaggggcccctgagaatcccctgcctgggtgtgtttcttctgattctgtccctcacgtctctgttttctcccttttctgtgctccagagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgggctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcaggggctctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggagatagcttctgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagc

SEQ ID NO: 467 - DNA, 2119 bp, Homo sapiens
agacgcggagctgggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacggacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcacttttccttaaccagttgtgcaaggacagcaacaaccaatctaatgatgagaatgtacttatattttgttttgctattaacctacttacggggttagggatttgcgggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgcgtcccccccccacccccttttttaaacaagtgttacttgtgccgggaaaattttgctgtctttgtaattttaaaactttaaaataaattggaaaagggagaaactg

SEQ ID NO: 468 - DNA, 4312 bp, Homo sapiens
aaacagtagaaaaaaatcgggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaaaagactctcctaagggagaaatcagtaagtctatagactcaacagaacctctggatatcctggagaaagatcactttgattcagatgatatgaagttgtcagaaatagattttcctatggctagaagcaagctgttgaaaaaggaattgccttcaaaagacttaccgaagacactgcttaaaacacttaaacgacagtccaaacaaactgattatgtggatgacagcacaaaagagctttctccaaggaagaaggcaaagttaagcacaaatgagacaacagttgagaatctagaaagtgatgtgcagattgactgtttcagtgaatcaaagcatacagagccatcatttccagagtcatttgcctcattggattcagtaccagtgtctactctccagaaagggaccaaacccattcaggctttgcttgcaaagaatattgggaataaagtgaccttaacaaatcaactgcctccttccacaggtagaaatgctcttgctgtggaaaaaccagttttatctcctccggaagcaagcccgataaagccagcattgacctgccacaccaatacaaaaggtcctttacaaatggtatacaaaatgccctgtggccagtggttgccaatagatcttcaaaatagctctgtaaagattcaggtgcagcctatggtggatcctaaaacaggagaaaaaatcatgcagcaagttcttattctgcctaagaattttgtgattcagcataaagaaggaaaagcagttgcaaaagaagtgccaccacttcaacagaaaggtacagaacaacattgttcatctttcccacagacaacaaatataaattcttctttagcatcagtttttgtcaactcaccaggaactgtttctacccaactaccaaatacagctttcaacaaaacaattacacctttatcaagtataagtagtgctagaccacagcctttgtcgcctgtaacctctgtaagtaacttattaacaccatcagttaagactagccagagtgaggcaggaaaagccaagaatgcagtttcagcagccacattctccttgcccagtgcttcaccgaccatttcctccacaggtcagcctctgtcatcaacaacaacactaaatgggtctacaaatcctggtagttccttcaactgttttgcacaacagactgctgattcttctgaagcaaagcaagagctgaaaactgtgtgcataagagattcacagtcaattcttgttaggacacgaggtgggaacactggagttgtaaaagtacagaccaacccagatcaaaattcacccaatactgtatcttcaagttcagttttcacttttgctcctcagctgcaggcatttctggtgccaaaatcaacaacttcttcctctgctttttcacctgtagctggaacaactactacatctagtctttcaccttttagccaaacaccaacttctgtttccattccagctagctttgccccatccatggggaaaaatctcaaacttacattaggccacaccactggcagtggtgatttgggccacgtgatagataaaacttcacacatgccctcttctcccttgaagtcctctatttgttctagtactctactaccatcaacaacaagtagttcggtaagtgtaattagcatatcagcagcaaattttggacaaaacaatgcaaatattattcatactccaactaaacagcaacaagtagattatatcacaaaaagttaccctgttacaaggtcagaagcaacagcagcaacaaatggagatgtaatcagtgggactccagttcagaaacttatgctggtatcagctccatctattctttcttctggcaatggaactgcaattaatatgacacctgcgctgacatctacaggtgtttctgcccagaaattagtttttattaatgccccagttcctagtggtacatcaaccccaactcttgttgcagaatcattaaaacaaactcttcctcctccattgcataaagcatatgttaagactccagagcaaccccaaatggtactgattccgtctacagtgggcacaccaataaaaataaattcatcaccagctgtgtctcagataaaggatgtgaaaattggactagacataggtcaagcaattgtaaatacttcaggcactgtgccagctataccatcaattaacatattacaaaatgtaaccccaaaaggagaagacaaaagtagcaagggctatattttgccattgtcaacaagtggtaattcagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcccaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccaggggtttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtggccaacctctacaacatcctctaagaagccctacaaaatttataaactcttttgggaatgcaagttctatacccacagtacatacatcaccacaactcataaacacaactgctaaggttcctgttccacctcctgtaccaacagtatcactgacttcagtaattaagtctccagctactcttttggctaagacatctttggtttctgccatttgccccagtaatcctccactgccaagtagcacttcagtgtttcatttggacccacctgtcaaaaaattgttggttagcccagaaggagccattttgaataccataaatactccagcatctaaggtttcttcactctctccatctctctctcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtatttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgcagtttgtattaaacttgaactgag

SEQ ID NO: 469 - DNA, 2451 bp, Homo sapiens
gcaagatggcggcccccttggaactcagttgctggggaggcggctggggactcccatcggttcacagcgagtccctggtggtgatggtgaggccgcctcgcgggccagggcgcaggaggaaggggcggggctggaggcgccaggctgacttgccccagtttcccgctgcgctgcggggtccaggagggccgagccgctgcacgctgcattgccctgggctccctcccaccgacgagtcccaacctggccgatacccccgccgaaggccggcggcgacatcaaggcttctccgcttggctccgagttttgtccgcctcacaaagctgtctgggcggtggagtgaaaccccgaagcaaggggcgcgccctccctactctgcatccccaggaccttttggggagcaaagtcctcgaaagccgggtggctggcgcccgcgtccctacttgagatcacggggagggatgcggcctcagtatcagtcgccttctgcctttgggggatggggctgtgaagtaaagctgctctgcagctttgcattacgcacttggtctaaaatgtttgattgcaaactctgtttcaggcttatgccaaattttctggtgcacccttgaaagtcaatgtgatagataacacctggagaggttcaagaggtatagtgtaaacctttacactcccctttctgcactcttttttttcttcttccatttaaagctgtgaggtatatagctataatattgaggatttagtttcttaccgtgaccttggctctgtgttgtttatggtttgatcattctgagtaatacctcaaagtgcaagcgaaatcactggaaattatgagaaacgaaaatgttctttagaaccgctctttgtgaaacagcaaaaaaaccaagacaagcttactcattttttcccctctaaatgtgcaactgctatagtttttaggatattggaatctctcagaggaaatcacactgtgtccttgtatgtaaactgttttttgattataggcgatgtaccaattttgacaactgaagacgacatggtttctcagcctcccaggtggctgggtttacaggtgcccaccaccacgcccgacttctttggtatttttggtggagacagggtttcgccatgttggccaggcttatctggaactcctgacctcgagtgatctgcccccgcttgatctcccaaagtgctgggattacaggcatgagccaccacacccggccttcagttaatattgtcttatgtgctttaaaaatccttaatttatttctaggccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggaggtaagctggctctttttcagctaatgtttgtttgcatattctcctatgtatgtataagcaaaatccactacttattttaattttagaagtttgtgtattgtctttaaatagtggtttatagcacttcaaggatttgtgtttttccgacttcatttttattctcatgttagttcttatttaaatagataaatagatatttgccttttatctattccgctggatttttacatttcttcttcttgttctttaaatattacccctttgaagtgggtcattttcttctaaaaggttaaaaccacaggtattaagtctttgctgaaaaacagtatttatcctaatgcaaatggacaattactttaaatgatttttacctgctgcttctagcattttcctgcatgaacagaaatcagcagcagattgattttggtgaggtacactgccatgattccactacttgaaaactgattgcatcagaatggaagtatagtaaatagagggcacctgttacttaggatgtgcttcattgagagagtggagccttgtgcttaagtgattcagatactaaatttctattgggatggttggctgaaattgtccttttaagaaacaggttataaagatagctggcttaggtggacagtttattattttttggtgggttatgtattctgtatacaggaaggggttagtagtttgggagtcatgaaattaagtaatgttcaaccgtgttaacttgggagcagtggttagcaaacctgattatttgacagataaaaaatcttgggtcctattccagacttactaaattagaatcttttaggcatcaatcctaggaatttgtatttttaagttcttctgaatactttggatgtctggtgggcagctttttgggagttactgccttagaagactatccagatagttgtgaccaaagacctatttgaaatgggtgtgagaaaggaatagcttaaacttgagaaggaaatgaggactactgtgcttttttttttc

SEQ ID NO: 470 - DNA, 2467 bp, Homo sapiens
tcttccggccgtgcggtccgcgcttttgtcccgctggcggccgggtttccgcggcgccgccacagccagtacgtgagtccgcggccgcccgcgctcccgcccccggcccttgcctgccacgccctcccctttttggccgggtcttggctgctccgcgggtctcgggcgggatgtgggagtaagcgtgccccctccccgcacatgtctcagtgggtgcgtttctggggagcggaggggagggaagacctcgggcaggcagaggggtgcagggcgcgcccctggaacagactgggctctgtgtgggccacaactgcgacgtttgaacggaccagcgtcatgttaggtctgctcaacgttccgagaagggccagggccccgctccggtgttcctcacctattcatccctgttttggatgggaggggatccctaaaaattagcgcttcaaaatacccaccatttcgtgctccctctgcagttaagtttggtactctaggacttgagagtgattgcgagggcagagagacctctaggggtgatctgattcgaccttcttcccctccgccccacccccccacctttttttctttttttttttttttggtcggtgagtgatgatgataagctcccgctgcaggtgtgaatagagaccccggaggcgcgtcctagccctcatctggggaagcgcacctgcatacagacgggtgcaccggggaggaggcgatctgccgcgtgttcctgcaagcagaaaaggagttaactaggttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatccctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccctatgtgtgtgataggtgtgggaaggccttcaggaacagctcaggcctcacagtgcataaaaggatccacacagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacataagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 471 - DNA, 2465 bp, Homo sapiens
gcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcattccaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctccaaccttgtggaataaatacatgttagcacttccc

SEQ ID NO: 472 - DNA, 2570 bp, Homo sapiens
gaagaagcccaggcgttcatggctcattgcgtcccgctctacctctgtggttctttgggagcgaccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccagtggcagtggtgctaagaaagaaaaggcaactcaaccagaaacaactgaagaagtcacagatctaaagaggcaagcagttgaagagatgatggatagagttaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaatcatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcc

SEQ ID NO: 473 - DNA, 2894 bp, Homo sapiens
aggatgcagcgcgctggcgggaggtttggagcagatggataccgtatcgacgtggggcctccggtatgttgccgctgcgttgaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 474 - DNA, 3256 bp, Homo sapiens
actgcttcggctagggtaccttgcgaccatgtcttccaagaagaatagaaagcggttgaaccaaagcgcggaaaatggttcgtccttgccctctgctgcttcctcttgtgcggaggcacgggctccttctgctggatcagacttcgcggcaacctccgggactctgacggtgaccaacttattagaaaaggtagatgacaaaattcctaaaacattccagaattcccttattcatcttggactcaacactatgaagtctgcaaatatatgtataggtcgaccagtgttgcttactagtttgaacggaaagcaagaggtgtatacagcctggcctatggcaggatttcctggaggcaaggtcggcctgagtgaaatggcacagaaaaatgtgggtgtgaggcctggtgatgccatccaggtccagcctcttgtgggtgctgtgctacaggctgaggaaatggatgtggcactgagtgacaaagatatggaaattaatgaagaagaactgactggttgtatcctgagaaaactagatggcaagattgttttaccaggcaactttctgtattgtacattctatggacgaccgtacaagctgcaagtattgcgagtgaaaggggcagatggcatgatattgggagggcctcagagtgactctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctggatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggaattcctgcccctagaggagtgttactttatggtcctccaggtactggaaaaacaatgatcgccagggctgttgctaatgaagttggagcctatgtttctgtaattaatggtcctgaaattataagcaaattctatggtgagactgaagcaaagttacgtcagatatttgctgaagccactctacgacacccatcaattatttttattgatgagctggatgcactttgtccgaaaagagagggggcccagaatgaagtggaaaaaagagttgtggcttcactcttaacactgatggatggcattggttcagaagtaagtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtataatgaagcaggtctctgtgccttgcggagaatcctgaaaaaacagcctaacctccctgatgtcaaggtggctggactggtgaagattactctgaaggatttcttgcaggcaatgaatgatatcagacccagtgccacgagggaaatagcaattgatgtcccaaatgtatcctggtcagatataggaggactggaaagtatcaaactgaagttggaacaggctgtggaatggcccttaaaacatccagagtctttcattcgaatgggtattcagccacctaaaggagttcttctctatgggccacctgggtgctctaaaacaatgatagcaaaggctttggccaatgagagtggactgaattttctagctataaaggggcctgaattaatgaataaatatgttggtgaatctgaaagagcagttagagagaccttccgaaaagcaagagcagtggcgccttccattattttctttgatgaactggatgccttagcagttgaaaggggcagttctttaggtgctgggaatgtagccgatcgtgttttggctcagctcttaacagaaatggatgggattgaacagctaaaggatgtgaccattttggcagctactaaccgtccagataggatagacaaggctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaaaatatctctgagcataagtttcaatcagttttacctggaaatttgtggtgtgttttaaaaaacaaatgtttagccttttcatttgcgacctagtctgttcatcccatgaagcgatttctttttccagaatctgtttgagtgtctttctaaaatgccaaacatgttggcatcaattttatacagggatataaaaaagtatatgtggataaattttctgtaatctttagggatataaaaaagtgtatgtggataaattttttgtaatctttatttttgaaggccagccagtaaaatggcccaatgtgccagccaggcttatgtggccttgttttcaaatatacatatatgtgttatcattaaaattcatatatgc

SEQ ID NO: 475 - DNA, 4928 bp, Homo sapiens
acccgcgagcggacggcggccgcgtagtgaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagccccccacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggcccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgagctgcctcagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacggcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccactgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 476 - DNA, 3716 bp, Homo sapiens
attctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcgggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttggggacaacgccattcggagtgggaagaaggtattccgtatgaagaaagaagtgcagatcaaattccacgtgctgctcacctcctatgagctcatcaccatcgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaggctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctccaacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaagtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggagggggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctgagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagccgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagagcagactccaccggcccaggcccagctaagagggggccgacccctttccccaggcacagccccaggctggcaaagggagggccctgggctgggtgcagggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 477 - DNA, 2113 bp, Homo sapiens
cttctcccagcattgccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaggcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtagttggtc

SEQ ID NO: 478 - DNA, 2641 bp, Homo sapiens
gcattagaaaaattgcggaattactgccaacagagcaaagccttctggatttcaggtccttgatacaagaagtcactgagatatgtttgtacaatggatgggaatttggctttctgtcttcatggaagaacttggcctcctttttcctcttccctctttcatccacggaaacagtatttagaagagcacagattcagcgttgtggttgtgccgtcaccatttccatgtagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaacttgaagttactgttgtaaggaccaagacctgctcattctaagaacacagaacactgacatctgaccagtacatggggtaaagcagagtcaggtgctgggaaaatgctggactcttgtcggccattaaccgactgaccatgtgaccttcgccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatatgcctggaaaatcctctctggcaacctgcccaaaaccacaaccagcagtggaggactgactatcagcagcctcctcaaggaaaaggagggctcagaagtagccaagttcactctggaggagctctacctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccacgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcactctcacatcgtcggtcttcaaacttcctgggacatgtgggttgttactgagtctctcccatgccctgtcttacttcctgccctaatcgaagactctctaaaaaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatc

SEQ ID NO: 479 - DNA, 3301 bp, Homo sapiens
aaaacccggaagcggatcgggtggagtgtaggtcatatcgccgagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtactttttttcagttagtactttttgaaagggatatatcatagtaatttttaaaagggatatgaggccgggcacggaggctcatgcctataatcccagcactttgggaggccgaggcaggcagatcacggggtcaggagatcgagactttcctggctaacagggtgaatccctgtctctactaaaaatacaggaaattagctgggcatggtggctggcgcctgtggtcccagctactccagatgctgaggcaggagaatggcatgaacctgtgaggcggagcttgcagggagtcgagatcgcaccactgggctccagcctgggcgacagagtgagagtctatctc

SEQ ID NO: 480 - DNA, 2929 bp, Homo sapiens
tcatggattcctggtgccagcccggctttgacatcaaggacgttgccagtttttggaagcacttggtgtgtgacgtctgtcagcaattacagagaaaaggcagcacctgacaaggagcccatatggtgcctgtatggattcagggaagccatgtgcatgtgtgtgcatgtgtgtgcatgtatgtgtgtgcccatgtgcatgtgtgcctgcaggtgtgcatgtgtgtgtctctgtgtgtgcacgtgatatgtgcgtgtgtgcacgtttgtgtgtgcctgtaggtgtgcatgtgtgtgcatgtatgtgtgtgcctgcaggtgtgtgtgtgtgcatgtatgtctgtgtgtgcattgtgttcgtttgtgcaggtgtgtatgtctgcgtgcatatgatgtgtacatgtgtgtgcctgcaggtgtacgtgtgttttcgtgcatgtggtgtgtgtgtgcatgtatgtgtgtgcctgtaggtgtgtgtttgtatgtgtgtgtgcatgggtgtgtacgtgtgtgcatgtgtgcctgtgcatgtgtgtgcgtgtggtgtgtgtacatgtatgtgtgtgcacgtgtgtgtgcctgcaggtgtgcgtgtgtgcatgtgtgtgcgtgtgtacctgtgtgtgcactgtgttcatgtttgtgcaggtctgtgtgtgcatgcatgtgtgtgtacgtgtgtgtgcctgcaggtgtgcatgtgtgtgtgtgtgagatatgagggatgacatctgggaggggaggggcttcctgctctatatctggtcaaggtgccccgagagtgaagcaagctgaaaggtctgtgaaggctccagggcccatccactggcaggcagatcccggcctccattccccacacagccccagggttgtctcactggagagtcacaggcttggacttggacgtcaggccgtcccgggcccatcctcctccacttgtcctccaagtcacttccactttctgagtttgtttcctcattcgcacaatggggctgagtccacctgactcaaagcttgctaagacttttcatcagagggagcaggcagcagccgcacagcgtcaggccaggcacagacagtaccctgaggtgacctccttgagcctggagaagctgagtccgaaggcgctgagcaggcaggtcttgcgtctgcaggagcggtacggcgtagccccagaagagcctgtcacaggagaactggaccgaccatgtgcagggcctggtggggcagagcccgtggcttcaggagcagctgtctcagctgctggtctcccacagtgacccagtcacggccgcccagtgtgccatggacctcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggtactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcatgccagccccagccgtggacagggccagggagctgaggggcctgagcctcctggtgcagcaggtgctgggcacagccctggacaagacgcagcagctgtccaactgggaccggaggccgctctgcgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggtccctgtggctgtggctgtgtctgagggcgctgcccctcagattccggccagggccttccgtgtggtgtgtgacaacatgctgcaggggctggcacggagcctccgctgtctcggtgtggatgcacgcatgctgggcaatggtgaagaccaccgcagggcggccgaggtcttctgttccaagctcttagtgaattctgtatttttaggacttgctctacaaatagtacagctttattttcaccctcatttgttttctgcagcttcaaggattgtctgtttatgtctgtctaggatgttctagacaggtgttcacatttgtgaccaccttactcacaggtgcagtgatctcacagaggcagacatagattcatgcattttctggagagaacatttttgaagaagggaagctttgaagcacagattctgacataacaagtatttgctacttccaagcactgcagtcaactaatggatataatgggatgggctggttgctcctaactgtgctggagaaggtgggaaagaaaaagatgagctcagctccacacgaaggacctgcaagcttctatcttggcccagaagaagcccttattccctgtagctgcagaagtaaaattgctgaacaccatgcctagagtttaatcctgtgagcagctgaattacaacagaaattaaattcacaactgatgttattaaactttgtccacttggccagtcctatccatgtaaaattacatttcattgtctttg

SEQ ID NO: 481 - DNA, 3737 bp, Homo sapiens
atatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctgttgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtcttcccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcattatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctataagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaact

SEQ ID NO: 482 - DNA, 4454 bp, Homo sapiens
tgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgtggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcagggcagcagtaactccgtttccgacactggtgcccatggtgtgcaggaatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggggggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaattt

SEQ ID NO: 483 - DNA, 2468 bp, Homo sapiens
tgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcttcccagaccccggaggcgtggaggagaggagactgtttgatgtggtacaggggcagtcagtggagggcgagtggtttcggaaaaaaaaaaac

SEQ ID NO: 484 - DNA, 3376 bp, Homo sapiens
tctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacagtgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaataaatgatggatccacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattcaggcaatttttgaaaacactataaatgtgtaattaattagccataaaatattgatttatagttaaccagcatatggtactaaatttgtaaatatggtgctatggttatatttatactgttcaagctggtggacaactctctaaactgtgattaaacttgtattaatggttccctaggaagtatatttcagtgagtcatgtccataacaaacatagatgttaatgttatataggttctacggagagcattactgggtaaaaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgagtctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaagttgaaaaaatcacttg

SEQ ID NO: 485 - DNA, 2516 bp, Homo sapiens
acccggaagagccgtcaacttagcgagcgcaacaggctgccgctgaggagctggagctggtggggactgggccgcaatggacaagctgaagaaggtgctgagcgggcaggacacggaggaccggagcggcctgtccgagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttggggctgcagtgaattatgattgtggcattgcactccagcctgggtggtagatcagggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactg

SEQ ID NO: 486 - DNA, 2275 bp, Homo sapiens
attagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaaggctgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaggcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagtagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgt

SEQ ID NO: 487 - DNA, 3472 bp, Homo sapiens
tcgctagccgccctgcgggacgccggcgctgatgggttggggaaatggacgcctggagaacggaaatccagttatcaaaattgactcaagaagagagaacctaacagaacaataacaatggaagaaattgggaacattatcacaaagctatcatcctgccaaactccaggctcagatgtcacagggtttctattgcctgggctggagtgtagtggcatgatcatggctcactatagccttgacttcctgggctcaagcgatccttccgcctcagcctcctgagtagctgggactacagagacggggtttcgctcttgtgaccaggctggaatgcaatggcgtgatctcggctcaccgcaacctccgacctctgggttcaagtgattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagttcctatctcccttcaatctattcttcatattgtcaataatttttttttttttttttgagacgtggtctctgtcgccaggctggagtgcagtggtgaaatcttggctcactgcaccctctgcctcctgtgttcaggcgactctcctgcctcagcctccggagtagctgggattgcaggcatccgccatcacacccggctaaatttcgtattttttcagtagagacagttttgcgccaggctggtctcaaactcctgaccttaagtgatccacctgcctcagcctcccaaagtgctgggattacaggcgtgagccgccgtgcccggccatcagtaattttttaaaatgtcacttcaataaatgcttttcctctgccataaagaccaaacatcttgctgtggcctacaggagacaggatgatccagcccttgcctcccttactctcatctctagctaaaactgcgctgctgtctctgcactccagccactggcacttcctgattacttggggcacgctgtactcatcttgctcccagcctctgcccatgcaggtgccctctgccctcagcactgcctttctctacttcatttatagactgctgtccttcagatctcggttgaagtgtcacttccttggggaagctggcttacactctcaggactcggttaggttcccccgtcaggctcttctatgtcaccatgtttctatttttcacagcacttacctgttttaattacgttgcaaatagtttttgtttgggtctagagaagcatgtattcactagtacattttatttgtgttctctaattatttttttctgcagctaaattagaaatttgtagttttccccctaaaaatgcaatgatgttttctctgattttcttgtcacctttcttccaaaaaatccatgtgttcaaagtgcttgcttgcagtttgccccataataaatggttgtttaatccaaatatctgagtagcaaactgagctgatccttctggagaaagtatggttgaatagccgagaccactgagtagtcgcagagaagaccacacatcctgaactcctcagtctggtgtgaggggaggacaatagataactggatgtgtagtgttcccaaacatcactgatcccaaaccattgcttctgcctgccactgccacaaatacagtacgactgccaccccttcatactcagctttaatcctcagcatttcttctggtcctttatgtgcagatgttactcaaagtctacatggaatgccaaaatttccacaggccttgatttttttcacggtgattaagatcagaagtagaacccatcaatactataacactgcactgactttctgatttcaaaagcaactctactctctacaacccacgcaaagtttttccttaccatttggaacccttcaggagttacactgaagccttgataagactgtttcagccaggagtggtggctcacgcctgtaatcccagcactttgggaggctaaggcaggaggattgcttgagtctgggcaacatggcaagactggctctatttttttaaaataacatttttaaaagtatgattaaaagactgtctttctattggctttgctcccccgatggtgagtgtctctaggagtcattatcaataacatcagtgagaatttctttgctggtcacatgaacaccaaattcaatcttcatatcaaccggtgtacagttctgggagcaaccgggatttctccgggatttcaaaaacagcctatgtggcatgactcatgatatccacttcagttttataccaagtgcagcaaagccaaattttgctgcaattagctgttgcctagaccactgtgggtcatgattggcatcatccttgaaaaacatctccactttaggtgggcaaaactcacatccttccttgacaccaggatttctttcgagtgaagaaccagttggtattcttctgcaaaccattcagttggaattatttcacactggggcacaatgaaagctgtctcctcacattttctggtgaaagcagttttaatacctgcttcctgtaacaacagaaaaatgcaactggtaattttatttgagattgcagcttttccttccaggtgattctgactgcatttcctgctgtaatctggtccttagattgcaggacttttcctggcctatctaacaagcaattcatagacctcttttgttttaccctcacatagttttttagcaatgttcagtacctcagctctcactattatcctgagtgggatgaaagttgcacccatgctgagaggcagaaatctctgttgtgaatatttgatacctcttgctttatttatttatttatttatttattgacacagattctcactctgtcacctaggctggagtgcattggcgcaatcttggcccactgcagcctcagcctcccaggctcaagcgatcctcccatctcagcattgccagtagctgggaccacaggtgtgtgccaccattcccagctaaattttgtattttttgtagagacagggtttcaccatgttgcctaggctggtctcaaacttctgagctcaagtgatccacccacctcggcctcccaaagtgctgggattgcaggcatgagccaccatgcctggccctgttgcctctttaaaaagccagtcctggcagggcacagtggctcacgcctgcagtctcagcattttgggtggccggggcaggaggatctattgagtccaggagtttgagagttcaagtccagcctaggcaatatggtaagaccttgtctc

SEQ ID NO: 488 - DNA, 2312 bp, Homo sapiens
gtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacagcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggaggcctcagatatcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggtcccctcttcaccatatctccactgctaccttgctggccccagagaccaccctgcccaaccaaaccactcaggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctgagacttggttctgggtccttaaaaccaggtttcctaggctgggaccctgtacatagttggtgtttaatgagtgtttatggagaggagagttctaaggtcacctctggctgcaggcatccagggattattccagcaatctgcaggtagggagtgggtcccagcctgggagcctgctgtcaggagcaggcagacctggactcacagcctggctgtgatgcttgttcgctcagcttctccatttatgagatggggagaatagtcacagcctcctcaaagggttgtgaaaatcaaatgtgataatttgtggaaagcccttagcagtggcctggcacaaaacaaatgctcagtggatggaagctgcctattattattgtcgttgttgttgtttgccatgactgctctgggccgggggtagagctagcatccgggcatgtacgagggaagagggaggcaggcctctattcaaaggcagaaattcctttaagattgtggtctgctgggtttcagggagtgtctgtgttgtttgtttttgtttgtttgtttgttttgagacagggtctcgctctgtcacccaggctggagtgtagtggtgcagtcttggctcactgcaacctccacctcctgggctcaagcgattctcatgcctcagcctcccgagtagctgggactacaggtgtgtgccactatgcctggctaatttttgtattttttgtagagacggggttttgccatgttgcccaggctggaagtgtctatgtttaactgcatcttatagaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatg

SEQ ID NO: 489 - DNA, 2884 bp, Homo sapiens
ttggtgaacattatcaatgtcactatgagggacattaataggaatgaaatactttccaggattacagtacttatattctcaaaaatttcctattgaagtccatctccaaaatctgaaccatgggagaacactaggactaaaagccgtaatgttgaccttgggaggcgactctccagagtaaaatctcctttgctgcgagtaagaccagatcccactacgctgcggtacaccagcgtgggcttgcccggcatgcacgagctctcggtgagctgcgccaagcaccgcagcgtcgtgtacagcagcaacgtgagcactaacaggctggacaccacgcagatggcgatgatcaggtacacgttgacatccaccagcgctgcctcccggacctcgacgcccgccaaagcccgcgatgggaccttcctcgcttggctgctctccgccagcgacgccaccacggtgacggtggcagtcagcgccagctcgcagtggtccttcaccagcaccagcaggcggtggcgcgtagctttcgcctcgtccagggtactcgtcgtgctgatctcgcccgtgcagagccccacgtggaacgggtgctgccagctgacagatgcagctgttgcgacaaccaggcgtcatagctggagtccaccgtgcgcaccttcgccaccaagtggcctgcatccactgaataccgcaccagctcactcacagcgccgccagcccacccaaggcgccagcagcgcagacaaagttgtcgttccagcactaatacctggcagcgtcacattgctgctcagaggcggcatgcccgcgtcgcgcgctctcacctagaactgcagcagctccagctcctcgtagtccagtggctgcaacgcgtacctcttgccgctctccgcgtgcacccacacatagctagacagcgcgcactcgcccacccgctgttccatcaacgagtaggacaccagcacgttctcctgcgcgtcccggtcccgcgcggacactgtgaagtcgtggcagccccgcgggttgttacctttcacgaacaccatgtactcgggctgctggaacgccagggcattgtggttcactgttcggccacttccacggacccgatggctgtggccaacaatgaaagcgagtccccattccgagcgattaccaacaatggatagatttgctctcttggtccagggcgctgtggagtaccaacgaatagtttctgggcagcgccttttgaaggtagacaccagcttgaagagacgtgaggagtcagggtgcgggtcgtctgtcccttggcactgaagttagggtcaattacactgattagggctatgacggtacccagtggagcgtcctcctgtacagggaatgatagtgacttactgctaactctggaacactatcattgatgtccaagacttctatcaagtctgtgcagtgatcaaacattggggaattgcttgtgtcaactgcctgtatttgaatctttcattatttagtttcctcaaaacctatctttacatttatttatccactgtctgaatctatgcgaaaaagggcttctatgttaggggagacatcagttgcaaagaaacaatgtgacggtttgaaccctcgtcaaaatccaaggggttaagtctaataaccagtgtaccttctcttgcattttccagtaatttcacatgatagactcctttgtcaaacactgggcatcatcatttacatccagcgctgtgatatataatgctttggtgcctgtcagctcagcttcgcccccatcagttgctttgagcaccaagagtagctctgaagtgacttacctatctgaaagaatttttaaaatacaccttcaagtggttttacctgctcttggtatttccagggaaaaataatcattgcggcacagtatgtaagtcatcagagcattggccccgacgtcggcatcacagacaccctctagtgaaacacgataatcaagagctctcgtttcagaaacagactcttttgtgttgctgagaacactggcaggttgtctttattgttcttcactttcacctccacatggaaaacctgtagcagcttgtccacgatcacttccaggtggatgctgcactccgagatcctcccacacagctcctcgaggtctatcagagaactcacaaaaatgccattctgcagatttacctccagaaggtttctgcggcttttggaatccaactgaaacaggcgcggtatcagctccacaagctccagacccaggtcctgcgcaatagggaccgcgaagacgctatgtgccgtccttggcctcttccaggatggtgtagtggaactggtcctttcccgcttcacaaaattcaaggagcagaagccagtgctgtaggctccgggattcctggccactttgtctagcagctaaaattatgcctctcttttggttagtaaaacaatatttcatgactagaaagacttagttcctctgagaccttttggtccttgttcctgaggttccaagtggtcttaatgggtgtttgtagtttttaaagtacaggaacaatggagcttctttctgatctaggaataatctgattttcttctgttaaaaaaaatacctttcgaccgggtgcggtggcactcggccagcactttgggaggccgaggccggtggatcacgaggtcaggagatctagaccatcctggctaacacggtgaagcctcgtctctactaaaaatacaaaagattagcctggcgtgttggcgggcacctgtggtcccggctactccggaggctgaggcaggagaatggcgtgaacctgggaggcggagcttgcagtgagccgtgatcgtgccactgcactccagcctgggcaacagagcgagactccgtctc

SEQ ID NO: 490 - DNA, 3627 bp, Homo sapiens
attcatgctgtcgcgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatacctctcaagcaacagcttcagtgggatcctagcagtcacagtttgcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattgatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcacctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttacgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtatattttgatgtttgtttattctacctcaaacagaggcttaagttttgaagtgtaaccagtttatacttcattttatacaaaacttattgctgagaagtctgaatattgtgctttttgttgtttgtaaatagaattgaatttaaatacaccaggataaatcttatttaaaggaagcctgtttgaaaatcaccaactttaacttattgcttatataaatccaagctctgtacctgatctttatgtaaagcaagattcatatgtgtagtatctaatgccctttggtgttacatttgactaaaatacaaatgtctgtatt

SEQ ID NO: 491 - DNA, 2898 bp, Homo sapiens
tgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaagatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcaaaagatacagattcggatgatagcagtattccaagaaaccgtctccagtctgttgtggttgtgccaaagaattctactttgcccatagaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaattccttctatcccttcagaaagacaaggggtcagtgcaagcacctgaaataagcagcaattccattaaggacactttagctgtgaatgaaaagaaagatttttcaaaaaaacttag

SEQ ID NO: 492 - DNA, 2996 bp, Homo sapiens
agttgctagtctgcccgcgcggtggccggagggaaggagcgagggggcgggcccttttacctttcgcgcgcatgcgtgtgggctgcagccttctcccgccgcctgggggggctgcgggtgagggctctttgggggcgtgtgtaggtttcgagggtcacctgaggggtttggaagatttctttgggggggcggttacaagatttgggggttccttttccatttgcaaaatgttctggggcttggggaagttttaacgtgggtttaggggatacttttggggttctctcgcgcttaaggggcaccttggagtttgggttcgtttgtaatgcggaaggttcggttgtgttttcgggatcgggttccctttgtgttttggagtgtttgttgggcatagaatttggggagctcccggagagacagaagcaaagagcccgagagtaccagtcctggaggtggaatgtctgggctcgcgtcttgacttcctacctgtcttaacccggacaggagatttcacctgtgtctcatcgggaactaggcattaataacactacctgcttcctagggaccgaggaggattaggaattgttagcgcagtacctacctagtaagctcgcagcgagcgtgcagtaagcacatgtctgctattgtaatatttgtgaggtttctttgtttttttttttggctttgtgaaacatttttatggtttaagattcatcttaaagtgttagggagcttttgtgttttcaaagagttcgtctgctgttggaggcttctagtggaattgggagataatggaggagggttggggggagtataggattccgggagagtgattgtttatgacatagtttggggaattgctgtgttgggatctgtgagagattgactgagattcggcccttcagtgctggagaggatatttttaggttcggtggtttaaagtagtatttgaaagcttttcgatatttgggggaggacattgagatgctgggggtaaggttggaactgattaggggacttgagggggtggccaggttgtagcaggatggcatctgtagagactggcttttgctgtgttagcctgcctccctgggcagttggttatacaggtcaagtatcccttacccgaaaatcttgggactaaaaagtgtttcggattttggatttcttcggattttgagtatttgcattatacttatcagttgagtatgccaagtctgaaaaatctgaaatgctctaatgagcatatcctatcagtgtcatcttggcactcaaaaagttctgaatttgggagcattttggattttcagatttgagatactcaacatgtatgtgaattggtggttggtaaacagccatctataggttttggaggctgtggagtgatatttttaacactgagctgagattacagcagggactgtaagtatttgaggggtaggtgggattggggattatggagtggagataaagattcttgacatggggattctctgtgtttactggtacctgtgagtgcttggaggctgtctggattttgttttgttttctttcttttttttttttttttttttttgagatggagtttagctcttgtcgcccaggctggagtgcagtggcaagatctcagttcactgcaacctccgcctcccggttcaagctattctcctgcctcagcctcctgagtagatgggactacaggcgcgcaccaccacgcctggctaatttttgtatttttagtagagacggggttttgccatgttagccaggctgatctcgaattcctgacatcagatgatccgcctgcctcggcctcccaaagtgctgggattacaggtgtgagccactgtgccaggcctggaattgtttgaatttagagggatggtctgtactgcaggagttggcaaactttttccataaagagccagataatgggtattttaagctttgcaggccatgtggtctttgttctgctattcagctctgctgttgaagatgaaagcatccatgaacaaatgagcatgtttcaataaaactttatttacaaagacagcgagctggattaggcttctgggccatagtttgctgacctctctggcctgtaggcatgtggaagtttcaaggtttaaagggtcattttggttttgagctgtctggagggagatgagccagagaaagattgaggcatatgttacttagtaggttcaaactgcagtgaaagtgatcatgtcggactcatgcgcaagattgcctccagattaggtcattcacatcaagtcattccaaaataaaatagtcattaacagagccctaaattgaagagtccagaaatcaagttgagagcctctttttgctccggacccactgtaatcttagctatgtcacccttccccactctgagcctctgtttatctgtgtgcagcttgaggagaaagctaggctagaacaggcaccctcgtgttttctttctttttttttcccaagatgggttctctctcagtcacccaggctggagtgcagtggtatgatcacagcatcacagctcactgcagcctccacctcctgggctcaagcgatactcccacctcagcctcccaactagctgggactacaggtgcgccacaccccacccggctaatttttgtatcttttttcgtagagatggattttgcccaggctggtctcaaactcctgggctcaagcaatctgcccacctcggcctcccaaagtgctaagattacaggcacaagccaccacacccggctttgttctctgttttttagagggtctcactctgtcacccgggttggagtgcagtggtgccatcattgctccctgcagcctggaactcctcctaggctctagaacaggccctcttactccgcgggtccacggctgtgctttagggaatcccctgtactgtctttgcaagggtgtgcatttttctgactgaggacacacagctttaataaattctcattaagccccactacctg

SEQ ID NO: 493 - DNA, 3057 bp, Homo sapiens
ttttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacgtggctgctctcttgatgtcctgcctcagtcctgagcgtcctgcatttcccctgagagggtgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggattttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagctctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgttgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccaagactctgtctcaaaaagaaaaaaaaaaaaaagagtatacctgtgcccggttgctgtagctcatgcctgtaatcccaccactttgggaggccaaggcgggtggatcatttgaggttagtagtttgagaccagcttggccaacatggggaaactctatctctactaaaaatgcaaaaattagctgggcatggtagcaggcacctgtaatcccagctacttgggaggccaaggcagggaatcccttggaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggtcaatgataatcgtcccctgtgggccctgggcgttggtgtcacacagaactgagaagcaaagcgggtggtgacagaccctggtaatgtgcagggagcgtctggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggtcgaggcgggtggatcacttgaggccaggagttcgagaccagcctggccaacatggcgaaaactcgtctgtgcg

SEQ ID NO: 494 - DNA, 3019 bp, Homo sapiens
actctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtaagccctggtctctttcagcaactgtctcaagggccttcccacccctactctgtagtccctgattttttttccccttgagcatctttgtgcagcttggactcaaacctcagagtccaaccatcctactcattagaccagtgttcttcaaactggtctgatggaaaaatcacctaaggggcgtgtctaaaatgtaaatatcccatcctcatctcacacttactaatttagaaactccaaggggttgggaatttattttttattttttatttttggtttatgggaattcatattttaacaaatatggtgatttaagtagtggagagtcctacctctcaactcactttttcattcatgtattcattcatttgctataatttttcagaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtgattccctgtgcgtatgcagtaaagtttgggctaaagcactgctttccagggaacactttctcttctttctctttcattcaccagtagactcttcacactgagacttagaagccaggaatcccagggacatgggtggaggccctgtggcccctggggctgggcatgcagccacacctcccttcacctcagcctctgttgccagatcctcagcctgggggaaggaagggaggctcataggaggtatttcaatgagctggaatgacttgctgaaaaacaacatagagttcccctcccttccactcttttccacgagggcctcatccttatgtaaagggaaccacagtgatctgttcacttctttcttgcctaattgccctttgctttgtgctctcctctctcaaagtctgtataagcctccccctctattccttgtcccccaaagatcacaatctccttcagacactattaatgtcccccaagtggcaaagtccctattcattttcattttctctttttttttttttttttgagacggagtctcgctcagttgcccaggctggagtgcagtggcgcaatcttggctcactgcaaactccgtctcccggcttcatgccattctcctgcctcagcctcccaagtagctgggatcacaggcgtgtgccaccacactcggctaatttttgtatttttagtagagaaggggtttcgccttgttggccaggctggtctcaaactcctgacctcaggtgatccgcctgcttcagcctcccaaagtgctgggattataggcgtgagcaacctggcattcttttttttttttttttattctttttgagatggagtcttgctctgttgcccaggctggcgtgcaatggcatgatcttggctcactgaaacctctgtctctcaggttcaagagattcttctgcctcagcctccccagtagctgtgattatcggcacccaccaccacgcccggctaattttttatttctagtagagacagggtttcaccttgttggtcaggctggtctcaaactcctggcctcaagtgatccaccctcctctgcctcccaaagtgctgggattacaggcgtgagccaccgcgcctggcaccgccgttcattttctgtgtgagcacttgttgtatatatactaggctcagttttcagaggggagaggcaagtgccttctgtatatccctccccagcacgtggcttcctgccagcatctcttttgctatcccatcttttctctttctggccacagcagcctcttcattgtgtggttcccagggcccagccaagcacttgctagaccagaggattttgacatttttttgtcctccttattctttctcagccttctctgtccatttcccacccccattttcagacctgagaggctcacctaaataatttaggtgtggataattcaggctgtaactggggacatggaggcaggggtagcaggagggttagtgagggcctggaggagagagctgggtcctggactctctgtggatgataagagctggccttgcagtgagagggggtagagtgggacggctgagtatctcagagcacacacacggcttaccacaatctcttgcctctgtatcagttttattttttattttattcactttttctttttttgagacaggatctcactccatcaccaggctggagtacaatggcacaatcacagctcactgcagcctcaacctcctgggctcaagtgatccttcccacttcagcctctggagtagcagggactacaggcacaccccaagatgcctggctaatttttgtattttttgtagagatggggttttgtcatgttgcccaggctattctcgaactcctgggctcaagtgatctgcccgcccagcctcccaagtagctgagactataggtgtgcaccaccacttccagctaattttttgtttttgttgaatctgggtcttgctatgttgcccaggctggtcatgaactcctggcttcaagtgatcctccagctaaggcctcccaaagtactgggattacagtcatgagccactgtacctggccccagactagtttttaaaaatagtgtttccacaggctgagggttagg

SEQ ID NO: 495 - DNA, 3222 bp, Homo sapiens
gtgaagcccaagctggtccagatgccggtcatccacccactgtccagcccgagcaacaggttctgtgtcaccagcctggaccccgacacgctgcctgctgttgccacactcctcatggatgtcatgtcctacttcaatgggtgaggatacaactagaagccagcagtctacaggctggaagaaggccctcaccagaacccaacccttggacttcggcctccagaactgtgagaaatacatacctgctgtttattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacagatctgaagtgaagacaggagatgatgagaaaagctcaccgcatcagctggttgcccaggccaggacctgaagggttgtgtggagtctggaaatattgtggacccaagaaccttgacctctcggtgcctgcgacgggctgactgctgggaatgaagcaggatcaatgatgggataaaaatcaagggtaagaagaggatgtaaggcagctggtgttaatggggagaaaagctcagagagatgcattttaaagctaaacaatggagaagggtttgagaagaacccaacaatgtgggagtgctacagcagggaaccatgaaacagaaacagcaagatggaggcagccagacaccaaactgggaactcagacacccagattccctccatggcctcacccctgggcaaaatccaactctgagccatcttcttcctccatctctttcaacccccacaggggctgcctgctcttcacagctgtggaggtgagggtgggcgtgggcgggatgctgttcagctgcagactttcttcctgggacgaggagacgtcctctctgttaggcttggcaggccctgccaagcagatgcatacattaaccacagcccagggcctgcgacaggtgtgctctctttccaagacctgcccaggatttagtaagggaaagtcaatcaggaagagaatggaaaacttatacagcttcattctgttgccctcaaatgggcatagccctatgtactaaatacatagccctatgtaccaaaaagtaaggcttagagaattgtagctaggccttgtccaagaagaacttgctacacagcctagaaaacaagatggaaagatatataaatatacatttcacagataaactgtaacaggtgaacaggtgaacacaaacatgagggagggttggagtctctaagattgagaggtctgagttagccaatgaagacatctgagatcctatccaagatttctgtggtcagaaaaagctgtaaatggcaatagagttttggtaccagaggctagagtggacaaatgagggccagggaggaaccggaaaatgggagacaggattttctaaaagctagaaaaaaatgaagtgattgcaatgccagtataactgatatgatatgaagggggacttatctcctgcagagattggagaaggtagaggaggagaaagaatccaaagattctcactgcctgagaaaacccaggcaatactattttaaagcatcagtcaaattgacattaacatctgttaactgtaaacagtcacactcccattaccccccttctccactaaaaacaataatcccaaagtgagcgctcagcctatgggtttaagcagagggctacagaaaacagggaagagacatacccctgggcttggattcccagagaggaaaccttggggccccagatgtgtcctcctgatctccctgagctattaatggtgtgatgcccgagggctgggcccttgagtctctcctcttctccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccatccttctgtcaggccaaaatccttggagccatcctcaactgctctttttgtcttacatcccacatccagtttgtcagaaaagcctattagagataccttgaaaatgcacccagaatctggccgtttctcggcacctccaccattgcccccggcctaagaagctctcttatcttgcatcttgggctggactcctacaacagccacaacctccctgctggtctcccagcttctagccttcccccatctcctgtcgttttcgacacagcagccagaaggatcctttaaaaacagaggttgatcctgtcgttcctcaaaatcctccaatggttttcctactgcactcagagtaaaagccagtctctgccttagatgctctgggatcctgtaccctctttggtctcatgtcctacaatctgcattctggccataatggtcttctctgctgttccttgaacattccaggaacattccccccatcccctcgtggcctcaggactggctgcttcctttggtatgctattctgatacacactaagcaccctccctcacctgttataaaaaattcgctgggaggccaataggctgaaatggctcctgcactttgggttcctaagtcagcaaactgaaactcaactcagagtgaaagtgttgtgtgtaacctaggagcaggaaacttcagcttaaccagccagaaactaccgactaacctctaacaagagatttatggtcagttaacctctaaatatgaactttccactctaaccaatcaaatagtttctttgtcttgctcccagagacaccttgtaagtgtcccctctggtttcctcggtggtggcgccctgaactgctggcggtctgccactgcctgattgataaaattgctgaatgctcaaataaacctgttaaaattgt

SEQ ID NO: 496 - DNA, 2660 bp, Homo sapiens
tttgacaatatgatgaaagctgttggttcctttccccaacacacacacaccgagttgtatcacgaaaatgtcatacaatttccaggttttctgagtggtgggctcagattgaggtcaaaggatcagacgacccctaacgaccttcatgtctctgttgatgatctggggacagccagatcccctgtgtccagggagttccttagtcccttgccaccaccagagaagggcaattgccacgggagctgcaaagaccctattcctactcctggtgccttacttatgcagcacgactgaattttttgttttgttttgttttgttgagacaggggcttgctctgttgcccaggctggagtgcagtggcacaacaatggctcaccgcagcctcgaacccctgggctcgggcgatcctcccatctcagcttcctgggtggctgggaccggaggcgtgagccgccatagctggctgatttttaatttttttttgcagagatgaggtttcaccatggtgcccaggctggtctcgaacttctgggctcaagtgatcctccctccttggcctcgcaaagtgctgggattgcaggcatgagccaccgcccccggcctgtggagcacacatgagtttaaaattactttcccttctgcctatatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcattgaaggacttaaaatggtccttagccaacacacagtagaacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagtagagatgcagactaacagagagccaattacaaagcagtgtgacaagcgtcatggtggaaaattaaaagctcaaacaagggcacatgggaggggcttccaacacagactttgggggatccaggaaggtctaagaggaaagtgggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaatcgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaagggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacagaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctct

SEQ ID NO: 497 - DNA, 2850 bp, Homo sapiens
gttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctacatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgc

SEQ ID NO: 498 - DNA, 3283 bp, Homo sapiens
agattgcgcgagggggagcgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctactgaaagcgcggctggtccccgcggccgccagagcggaactcagccgctccgacctcagcctcatccaacagcagcagcagcagcagcaacaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttgggtaaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagaaacagaagaaagagtttccatggtaaaaactcgggacgattttaaaatctacaatgaagatgtttcatttctatcagtcaatcaaaataattactcaagaaacccaacacagtctttggagcccaatgtagggtccaaacaacctaaacatattaacaacaatctatcttcatctctaggtgatgctcaagatgaaaagaggtatctcacaggtaatgaggaggcgtatgggcgttcccatattcctgagcagcttatgcatatttacagccaacccattgccatccttcaaacatctgaccttttctccacaccggaacaattacatactgctaagtcagctactttgccaagaaagggacagttagtctatggccaattgatggaaccagtaaatcgagagaactttacgcagaccttgcccaaaatgccaattcattctcatgcacagcccccagatgccagggaagaggatatcatacttgaaggtcaacagagcctgccatcccaggcttcagattggagccgatactcaagcagcttactggaatccgtctctgttcctggaacactaaatgaggctgttgtaatgactccattttcatcggaacttcaaggaatttcagaacagaccctcctggagctgtccaaaggaaagccctccccgcatcccagagcctggtttgtgtctcttgatggaaagccagttgcacaagtgaggcactcctttatagacctgaaaaagggcaagagaacccagagcaatgacaccagtctggactctggggtggacatgaatgagcttcactcaagtagaaagctcgagagggagaaaacattcatcaaaagcatgcatcagcccaagatcctttacttagaagatttagacctaagcagcagtgagagtggaaccaccgtctgttcccctgaggacccagctttaaggcacatcctagatggagggagtggagtgatcatggagcaccctggagaagagtcgccaggaaggaaaagcactgttgaagattttgaagctaatacatcccccactaaaagaaggggcagaccaccactagccaaaagagatagcaagactaacatctggaagaagcgagaggaacgcccactgattcccataaattaactccaatggggattgtgtgtctgctgtctcgtgctgtttattcttgcttcttgttgtaaattgcagtacgaacttaagaaaatgagactgagcaatctcatggttcttggacatgtctcaagcagagtaaatggtaattcagtaatcagagagaaagataccaaggaatgctttttctggcctattcatttatttttgggtgatgaatttacagtatctaagttttcaaaatgtaaaatagcttcaagatgttagttatctgaaaatgttgctcagccagccagtttggccttgactctcttaagaataacagtgaaatatatactcctcaagttgcctccaaaaatgttgcctctaccatggtgactaccccatggaacatttagaaacaaaactgacttcaggcatcatattattttaaatgttactattacgtcttcttctgcctatacttaaaaataacttgataaatgacttggactgatgttactctggagttatcacaaagaaaatgttgtttggtctttaaagagcatgtgtattgtatcatcccaaacgtaaatcctacatttatataagatgggcaagaagctacttggtcattagagagggagacaccagctctttggttgtttttggatataactttacaaaataagtaagatgttaatttagaaatttgagaaattaatgctctaatactgagtttttatttaaaaattattttttcttcccctcaacaatgaagcaagcttagctgtcaagggaaactttttacaaatctg

SEQ ID NO: 499 - DNA, 3492 bp, Homo sapiens
tgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacaccaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgtt

SEQ ID NO: 500 - DNA, 2754 bp, Homo sapiens
actcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaagatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgattaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaat

SEQ ID NO: 501 - DNA, 2436 bp, Homo sapiens
aatggaggagaaaaggatctttcatccagcattcagtcagtggcctctgcctggagacaaagcctgcccagctggtgaccagcaagtgtcaggctgacgcccaggcccagcagtggcagctgttgccacacacatgacggtagccctggggcctcctgtaccttttgcatgagacttcgggaccggaagggggttagggtgggggagtgcaaagtgggctgttcccatctcctcacatttctgccaggaccatcagcaaatacccaccatgacacacgttctccaaagcttgttctaggagggcgcaggcgggcacgccccgatgccctcagtgctgtcctggccttgccccgggagaggagatggtcagggtgctggactgttgctgggtagagactgagtaggtgcccctggccctttgtcctctcccttggcgcttcttggggctgggacaatagtgtgtggtctctcccttgttgcccggagaaagcaaggacagaagcccacacaggggtcttttgggtcatgaggcccagctgtgcaggcaggcagggccaggggaaattgggcagcatggatggagaggctgaaggctgggaagagggaaggggagaggggcagcctgcaggggtagctgaagaacaggaaggaggtgagaagcccggtgacctgtcagagatgccaagcccagggtggcactgggttgggtggggacggatggtgtcttggcagcaaaggatgggtaatttgcaaatgaacatggatagaagagcagcaaagcaccaaaagaacaaggtctcttacccaggacacagtcccttccacactttaccagccccagggtctgagcccgacgctgcctcttccggtcctgtgcctgtgggtgcccacattcttagcaagaggctgcagagggatctttaggggaagattcgggcgtagtttattaaacagactccacttctatttggccatgtgtcaggctgagacctctctctcgggcattaatgagcagctagtgccctgtccctgccgccaggacccactgaaaggacgggtagccacacacatccctgagtagtcccagcctcatttgtcatttttgactcctgctttctcaaaggtttttgcctctgtcaatacagcatcatgggtggttggaaagaagggaacttcccttctggaccaagaacagcccctaagtcattagggttcaacctcacccttattcccctccccgctacaggagcccctaagtcattagggctcaacctcacccttattcccctccctactacaggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagtgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagccggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtcc

SEQ ID NO: 502 - DNA, 2830 bp, Homo sapiens
attgttccctcccagaggatctaagagtattggaagtttccaaccattggtggtactctatgctcatcctacctcctttgctgaaagacagtgtggcagcgcccctgctgtctgcctactaccctgactgtgttggcatgagcccctcctgcaccagcacaaaccgcgccgctgccactggcaatgccagccctgggaagctggagcactccaaggctgccctctccgtgcacgttccaggcatgaaccgatacttccagcctttctaccagcccaatgagtgtggcaaagccctctgtgtgaggccggatgtgatggaactggatgagctctatgagtttccagagtattcccgagaccccaccatgtacctggctttgagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagaccgaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccagtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggacgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagttttgtgcacccattggcaaaacaggaaagtttccagataggtattgtatcattgagaatgcagcactctgggaggccaaggcaaaagaatcacttgagcccaggagttcgagaccaccctgggcaacacagtgagacttcatctccacaaaaaaaatttttaaaaattagctgggcatggtggtgcatgcctgtagtcccagctacttgagtggccgaggcaggaggattgcttaagcacaagaggtcaaggcttcacaagaccctgtctc

SEQ ID NO: 503 - DNA, 3015 bp, Homo sapiens
caactcaccataaggagacatacactgagatagctggaatgcaacggtttggggctttttatatggattacctgtatacagtggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaagaatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggtttcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagaccc

SEQ ID NO: 504 - DNA, 3767 bp, Homo sapiens
agaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatagcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctccctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctcaaaaaagtcattttcagagaacacctttatcaaaggcaaattgctgtttttcagtcagctgccacctgcttctcattttgccctctgagaaaaggcatggtttcttaattgagggaaggaagcagattctgaggggtggagataaagctggggattggagatgttcccctgcctttgtgatgatggtttggtttccagacctgaggcatcgaatgggctaaaggtcagccagaagtcagagggctctcagccttcatccagccgcagccctttagagttcctgaaggaggcaggttccgctttgctttaaaagagggtcttccggtgttccagagtgtatcgttacagtaagacatgataatggccggctctgcaaatttatcatatagtttttttcccaagaaaattatttttgaaattaaaacaggaccccaaatgaaatccaagtggtcttctgtagaggaaagcatgataagaggaggaagacataaagttgggggtggagaggctgctgcccagaaactgctgggttggtgggatccacacagatgggcatcttggctctccctgccagaaaaatgtgctctgcagtgtcctcccaactgaaaacaacagtgacatgtttgaaaagcagcaatcgaaagtcagtgtgttcttgtaaaatgaatatgtatgtagggttttaacccttccattacttgaataattctttgggccttctgagtttaatggccatattttcttccagtttattttccttccccatgctgttgtccccatgctgcctatttttttaaatttcatagattatatttgaattgttacat

SEQ ID NO: 505 - DNA, 3465 bp, Homo sapiens
aacaccagctcgcaggtgctgcggactccccagtccgcccgccgccgccgccgccgcaactgttggcggccagagacggcgaaagaggagagagagggacccaggagcgcggcccccgggggagagagaggggagccctgcagtggagacaggtaatgagccaaaaagatcatgtctgaaatacaaggaacggttgagttttcggtagagctacatgaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaagccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttgtaaggtgtccagagctgggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtactgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccctggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggcc

SEQ ID NO: 506 - DNA, 2464 bp, Homo sapiens
gttgcgatggcgcagaaaccccgttgacaaggcactgctttttcatgacgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccaggtcaggagcttcctcagtttgtccctgtcctcccaacaccacgggatgctcttctcacttttctccctcattctgcacgaaagctttctggcttaatctcgtctccactccgattattcctttctttctgtatcctttccgcaaataatatactgtgttgcatcaactctaagatagcattgggccgggcacggtggctcacgcctgtaatgccagcactttgggaggccaaggagagtggatcacctgagatcaggagttcaagaccagcccgaccaacatgatgaaaccccatctctactaaaaatacaaaaattagccaggcatggtggcacacgcccgtaatcccagctactcaggaggctgaggcaggagaatcgcttgaacccgggaggcagagcttgcagtgagctgagatcacaccactgcattccagtctgggtgacagggcgagactctgtctc

SEQ ID NO: 507 - DNA, 2365 bp, Homo sapiens
actgagacgcctgggatctcaaaatggcggccccgtgcggaaacagcgtctgggagcagtcatgttgcctcctgaacaaagccgctgaagatgaagaatgggcaaaatcgccccatacggaacagcgcagcctcgggagcccgttacctggctcgcgaacacgaagcgggagagttcgccaatatggatgtgacagcggttcccattaagcggtgataggatttttgggacctgataatcaagctagggacctgattcctcagacctctgccctatcggaagggaagcagaaaatgatcaggtctcagggtccagtatcatttgaggatgtggctgtggatttcacccaggaggagtggcagcaactggactatgctcagaggaccctgtacagggatgtgatgctggagatctatagccacctggtctcaatgggatatccagtttccaaaccagatgtcatctccaagttggaacaaggagaagaaccatggatcataaagagacacataccaaattggatctatccagagagagtagacttgacacccctcaactggatatatttagagatgttttcttccataaggagacactggaaagtattacagggggtcattcattgtactccattttaaaagtctggcaaggtgatgaccagctggagagagatcaggaaaactgagacaaatttgtcaggcaagtcgtagtcatcaacaacaaaagaatatctgaagagtcaggtcatccatataatatatctggaaaaatatttcatgactgcacagacctagatacttcaaaacaaagactgtgtaagtgtgattcatttgaaaagaccttgaaaccaaatattaacctagtgagttataataggaattttgcaagaaaaaacattgatgagaattttagatgtgggaaaacacctagctacagttcttgctattctaagcatgaaaaaattcatagtggaatgatacactgtgaagctactcattgtggaaagattcttagccataaacaatctcttattcattatgtgaatgttgaaactggggagaagacctatgtatgtgttgaatgtggaaaatcctttctcaagaagtcacagattattatacatcaaagaattcatactggagagaaaccttatgattgtggtgcatgtggaaaagccttcagtgagaagtcacaccttattgcacatcagagaactcatactggggagaaaccttatgattgttctgaatgtggaaaaggcttttctcagaaatcatccctcattatacatcagagagttcactctggggaaaaaccatatgaatgtagtgaatgtgagaaagccttctcccagaaatcacccctcattatacatcagagaatacatactggggaaaagccctatgaatgtagagtgtgggaaagccttttcccagagtcacagctgattatacatcacagagctcatactggagagaagccatgtaagtgtactgaatgtgggaaagcattctgttttatacattaaagaattcacactggtgagaaaccctacaaatgtgctcaatgtgaggaagccttcagcaggaagtcagaactcattatacatcagataattcatactggggagaaaccgtatgaatgtacagaatgtgggaaaacattctctcgcaagtcacaactcatcatacatcagagaacccacactggagagaaaccctataaatgtaccaaatgtggaaaatccttctgtcagcagtcacatctcattggacatcagagaattcacacgggagaacaaccttatgtatgttctgaatgtgggaaagccttctctcagaagtctcacctcccagggcattggtgaattcatacaggagagaaaccttacatatgtgctgaatgtggaaaggccttttctcagaagtcagaccttgttgtacatcagataattcatactggagagaaacctgatcgatgtactgtatgtgggaaggccttcatccagaagtcccaactcactgtacatcagggaattcatacactaatgaaatcataagaatggtctgaacacagaaaagccttcagggtcagttcaagccttaatagatagtgcaacaaccaatggatttgatgattttggggactacatctttgttgataaaattttacaagtgaagtcatgttcctaatgtatttcattctttatcaaagataatagagaagtcaatacgtaaatgatggacattttcactatggcatataaaagtttttaaattgagaaatgaatgattagcataacagaacgaattgcatgtacatctcttttgaagttatgtgctcctgattatactacataacaatc

SEQ ID NO: 508 - DNA, 2905 bp, Homo sapiens
agaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaataggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctctatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctatggtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatgg

SEQ ID NO: 509 - DNA, 4038 bp, Homo sapiens
attgaatcagaatctgcatttcaacaagatctgtaggcgattcttatgcacattaaagtttgagaaacaccggtccatgccgtctgtttttccatattctccctatagtaccagctggaatatcccggattagccagccaggagcccaggaacttacacagtactgtcatctctgacttctctgaccatcttcaaagatggtcctctgtaccctgtgttggaaatgctgtgggtggggagagaaagccttaccctgccgcagctcagtgttggatgtgagtttggaaagatgagtcatccagcgggattttctccaggccatgagccaaaggtccagattttgttggtttatgtttggatcacaggatctgagtttctgaatgatcctattcctatgtttgtcttgtagtgcaaagaaaggaggtacaggcccgagctgtgttctaccccctcttagggttgggaggagctgtgaacatgtgctatcgaaccctctacatcgggacaggtgagccagccaggaagctgggagagacactgaatctgttcagccctaaagactgacacccttacccacagaagttagaaaggggtgagggaagccctttccagagttgactgctttaaatcagtggatagctagacaagagaaactaagaatagagacaatcagccagtcacggtggctcacgcctataatcccaacactttgggaggacaaggcaggaggaacacttgagcccaggacttcgagaccagcctgggcaacatggtgaaaccctatctctaccaaaaacaaatataaaaaattagctgggctaacatgcctatagtcccagctacttgggaggctgaggtgggaagatcacctgaggctgggaggtccaggcagtgatcctttttgtgcctctgcactccagcccaggcaacagagtgagaccctgtctcaaaaataaaagagacaatcagttccttgtcttcccttgttcaggcccttttgctttgtctttgcccagtgttgcaacagcagagatgaaagtcagctctgactactgcccagggaggcactttaaacactgcagggaagaacctaaggagaaggcagatgctttgtccctggtggtctttgaaagagtgatagactcacacatacccaatcttcagttagccctgtatctgttttttgttttgttttgttttccctaaaagtcctagagaccgatagctctgtatctggtacagaaggacagacagattagcccttaccctagaaacttccctttctttaaggtgataagattttctaggctctgcaccccgatgttgtattttcatagaaatatcccatcctcttcagtagctcactcttcccttctgggtagcagccacatgttctaaagcagatcagctggcagggacagctgttctttatcaggagcttggaaaagacaacagtttttgttcaaaaataaaaggggagggccctgagctactcacccttgaagtctctgctagtgccaacccagaagctaactctctccctgtcttacctccccgacacatgcaccttacaatctgttctctgccttccttttcctctactcctgccaccttgcaggagctgacatggatgtgtgccttacaaactatggtcactgtaactacgtgtccgggaaacatgcctgcatattctacgatgaggtgagggccggagatgcggtgggagggagctttcccaacctgaggcctctcccaggcagtaggtttttgttcagtgccctgaggggagggaagagggattgggggtcctctctttttcttccctccctgtcattcctggaggaggagagtcttgatgtgaaatagcatcctacctgggaagctacctgcttcccaggagcagggctaccatttttcctgaggttagtcacaggcacaacagagggagcctaccctaaagcaagggaggggaccagcatagaaggaagccaagccttgtgggtgtgtccctgtgaatttcattatcatcacgggccagtgagtatcataccaagaggagcggtgctgagagggcagagtgaaggagtgggagagtagggagtgtgggacaccagaaggaaagcttccctgaggaggtgtctccagcccccttctgaaaggacaggggccatgactggggaggcaagtaaggactctctaggtagagtagcacggccttctccatatgtcctctctccccttagccccaggccccacacaacagaccacacatcttatctcccctcctcctcctcagaataccaaacattatgagctgttaaactacagtgagcatgggacaacggtggacaatgtgctgtattcatgtgacttctcggagaagaccccgccaacccccccaagcagtattgttgccaaggtgcagagtgtcatcagtaagttggagcagagatctgtggccacaaagctgaggccccagtcagggtggttctgacttgctgcccatggtctgtctcttgccttcccagtcctattggccaagctctacttcctcgtgggcccagggcaggccacagagaagcaagtgctgagtacccccatgtgtgtacacacctgtggggacttcagactccaccaaccctttctgagcatccttcctccctagtcatgcagcagttggaatggggagatgcaggagcccaaccttggcaaacagcccacatgggttggctgctcactgttcctcttctgtgaccatccccctttttcccagggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttc

SEQ ID NO: 510 - DNA, 2885 bp, Homo sapiens
ctctcaaggatcatgggagcttgagaaccgtgggtagaccatggctgtgcataggcactgggtggccatctgggagctgtggggaccgctgggcccttgtgggagcttaggagttgtgggggtcatttggaagcctagggtgcacaggactggacatcagatgattggaggccatctgtggacgtctgggaatcagggatttatagagatctggggtgcttgggaagcatctctggatgtctgggggatgtgggggctgtgtctggatacctggggagcacggggatcatttgagagaggtgacagtaggtagcatacatgtttgcggcatttctcccaactgtacaaaggtctggcctaagcagggttcccaagccagatattcctcccaagagtgtgttctgagcatcccccaccctgggggcaggcctgtgtgggagtccagcaggaaacttcaccctcggcagtgggcagctgtggtgcagtagagggggcacgacttccccagggcattgccctttgcccattcctgccccatcctttccaaactgtatgtgtctttgtcccatccttccagggaagaactgaacctggcagtgctccatgcttttgtggatctgcatgagttcaccgacctcaatctggtgcaggccctcaggtgagtgagggggaggggtttggaacgccaggaatgtacctgtcagggccttcctagttacaagtgacaaaccttactcaagaaaaaaacagaaacaagcaaaacagaaacaaaaactagggaactgagtgtgtcctgcaccataaaagttcagggttatggcctccttcaggtatggctatatccaggagctcaaatggtggtcagaaagtcgactttctttgcctcttgtatttgccactgtgtcagcattgctctctgcagacccgcttacctgataacaagcctcaaccaacccccagacctgtctagcgaacttagcagaaagaggctatttctgtagggattcacaacactcccgtggccaatgcccattggtgagattggatcatgtgaccatacctgaaacaactgctgaggccggaaggtcgggattcctcgtggaccagttcctaacacagggactgagagtggggacaggctcccaccagccctggcatccattcctggcccctccccaacccaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggtacgtgccctcccgaccccgctggtccctccgcaggaggacatttgtgggcctgggccctggactcagcttccgcacacacctgctgcctgaactgaggcaaatgattcgacctctctgaacctcagttttccacacccaaaaaatggggctgaaaataaaatcgggcctgtgtgctgggcctggcctgtagtaagtacttcccaaccccttctcttgacccacaaatgttgatggagcccttctgtgccaggccctgagctgggctgaggaggcagtgagaggcagctgacattgtcctttcgtgggagaagagttcactcaggcttctttccactgcgttaacccagcccgagggagccaaacccctggaatctattccccttggcaagaactcccagggttccaggcaggactgaccccgcactccgaggcatcaggcccagagcacttggctgatccaggtgccatccttcccgaaacaccacccacaggcagaaaagagccaaacaggccaggaaacctgtcccagattctggcttccagctgtggagggaatagccagggctggtgcagatgagtcgggaaacccagcagagatggaggggggagtcttcgtcataacacgtggcactggcacattcaaggtcggttagcatggatcagacaggatcgtagcatgatgaggggttagcacaaggactagagtggttctcagccctggctgtacatgagatttgcctgggcaactcgaaaactccggtggctgggccatagactcctgaagtcaggctctcaggagcagaagggccatcggtcatcgtttaagctcctcgggtgctcccaatgcatagtcaaggttgagagctactggcctggagccgtgcctggtaacagtaggtgccacctgcgtgttagatgtggtttataatggagacacggtgcacagctgctccagagagacacatctgggcagttacagtccagcacagcagtggaggcttcccgcggcagcaggagagcccacaggaagctttcagctcagtgaagggagtcaaggtcaggcttcttggaaggaggttggacagggcagctttggcctctgagtcttgggggcctccccatgtggaactgtgctcttaaaccagggcatcaccacctcaacagatgccagggtttcctggtaaatgtaaaatacacaagtcaggcagggcacaggggcccacccctgtaatttcagcactttgggaggacaaggcaggaggattgttagaggtcaggagtttgagaccaacctgggcaatataatgataccccccatctctac

SEQ ID NO: 511 - DNA, 3490 bp, Homo sapiens
gtgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctggacctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttg

SEQ ID NO: 512 - DNA, 2933 bp, Homo sapiens
acagttgtacgttcgtgacgtcggcggttgccgtggagagacccgctcggtcccgaccgagagctggcgtcaggagccgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccagacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccaaaatatcccgggcttctgggggcaagcatttcagaaccatccccagctagcatcctttctgaatagccaagagaaagaggtactgagctacttaaacagcttggaagtggaagagctcggccttgccagattgggctacaaaatcaagttctacttcgatcgcaacccgtatttccaaaataaggtgctcatcaaggaatatgggtgtggtccttctggccaggtggtgtctcgttctactccaatccagtggctcccagggcatgatctccagtccctaagccagggaaacccagaaaacaaccgtagtttctttgggtggttttcaaaccacagctccattgagtctgacaagattgtggagataatcaacgaagaattgtggcccaatcccttgcagttctaccttttgagtgaaggggctcgtgtagagaaaggaaaggaaaaagaaggcaggcaaggtccaggaaagcagccaatggagactactcagcctggggtgagccaatccaactgatcctgcacaagtctccctgctacctcctgctgggctgctcctggttgactacatatttggctctctgccttctcttcatgttggcctctgtgtactatagaccctttggactttagttacaagaatatggcatttatgatcatgttcttttgcctcccatagcctcttgcttttctacgttagtgtcacatgttatgtgatcgcacccggactgttcatatgttaagcacacatactttagatgtgtgctccctgttatctacattgcctggaccttgttcttggctctggcctttcctacttgtctttaacatggacactcatgagtcatcctccaggacgaccagtgcatcctcaagctctgctccttcagggccagtgacttgctgggcttcgtgttcatgctggccatgcatgtcatctatgcaagcgtttccattgccactgcagaatgaagccagtgcacatggtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttcggtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccagtaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagaaaattacttggtacaataattattgtaattaagagatgtagcctttattaaaattttatatttttc

SEQ ID NO: 513 - DNA, 2603 bp, Homo sapiens
gcatttgtggcgctaaaaaaagggatgggcgtgggagattccaggacttgtgctcgctgaagatacaactgttagtccaagctcctgtatcagcagtgcttgcacctcataggtgatgatcatgagggggacaaggagcctctagacttaagagacaagttgccagcattctccagatggagtgtttccctccgcagcaccccctgctggtcagtttgacaagcaggtgaacagaagttctcaaatacacaatagtagattctatcaatcaagttgcataaagagttctgattcccagagatagcagattctgtcaaccacatttcataaagagttctgattctaagagagccatacacctgaaggagggatggaaagactaggagagcctgggatcctcagagatggagatctggatgtgaagagaaagagaaaaacaaaagtcaacagacagtactgtgaccaagtcagtgatggtgagatcagcagcatctctaggacccttctgattgacatgaagtcaccatcaagtaggcagaactcacagcaggagacctgtctctgatgctgctgagccactttgacaatcgttatatagaaatctgattggatgccgtgaaactggacatcagcaaaatgtcagaatgggactttctagcatttatcctcacacagaaacatcaatttaaacaactatctatgcatgaaaataccttcagaagagctaagaaaaccaggtgaaaggttacagaaatgttgtgtagcagagaaataagaaaagattaattgaagagcataggaagaacaatttttcatttcctgtgtcacccctcccacaacaccaggcagcagggcacagagagaggcaatctctgtgtcgaagaagaaaagtgaagtgagcactgaactttgccttggactccaacgcagagcctgcttcagtaaaatccagtaatgggtatgcgactattgcccgaaactccaggctagtacctgcacactaagccagaccagatcacacagcccaggctccaggcttgcctggtggacttggtttctgggtatatcctcatgccaggtctaccccagtgccttggatgtcagacagtctttgggaccaggccagccccagtgactccaggctccagactgctcccagaacaaggccggcctcgacaactccaggtttcaagccagccccaggaccaggctagctcctgcaactctagtcaccatgccagtgtccatatatccaacccctaatctggcccctgtggatacaggctcgaggactgcctagcacaaggctagcccctgtggtcgcagactccaagtccaccctaggttccagaccggcccagaactagattggctcacaccaatccaggattcaggcccaccccatttccaggttggcagccctagccctaggccttagtcaggtatctggcaagcatctgcagacccaggctccaggcctcccgaggcctaagccagtttctgccaccccactctccaggccagttcctatggtcccatcctccagcagacccagggtccaggcccatcacagttgactccagtattgggcaggtgcctacagacccagtatctagtactgcctctgtggacttaggttccagtccagttcctacagccctaggacccaagccaccctttgtggccctagtgtccatgcccacttctgaatatgttggttctaggacagatctcacacaaccagcctccaggccattccacaattcttggcccacccctgtggctacaagcaccagtctagcacctatggtctcaaactttagactggccccatctcaccacagccctaggccagcatcagactccaggctggtttttgtaacccagcatccaacaaactcagggcccagctgtgctctagcagacccagggtacaggccgacttcattagaccctgttgctaggctggccatcatggacaaagtctctaggaccatctctgaagactcaggctccaggtctgcccccgtctaccaagatcccaggcccatttctccagattccggctccagtcctgcaccagtaccaggccagtccccatggactcagatgccaggcttatcccagcagactcagacactatgctcattccaaaatctggccagcccctgcagacacaggctcaatgcacgcctcagagccatgttagcccctgtggacccatgctcagtccagcacctactgttaacaggctctgtacctgcccttatagaaattggctttacgttcatccccacatacccaatgaaaagatccaccccagttgatccaggcttcaggcccaactctacagacccaggaaacaggcctaccatctgctaacacaggcaccaggccagcctgcctgaggactttggcaacaagttcacctgcagaccacactagacaccctacaaagagttgctggatgactaggaaagggtttttccagataaagccggtatgcaagaactagaataagtttcttgtttttcaaatgtgcagacactaatgcactgcctaaaaatcaagatcaagaacaatcagagaaaaatgataccacc

SEQ ID NO: 514 - DNA, 4413 bp, Homo sapiens
tctgtctggtcctgggcttctcttttggttggtaggctattgctgcctctatttcagaacatgttattggtctattcagggattccacttcctcctgatttagccttgggagggtgtatgtgtccaggaatttatccatttcttctagattttctagtttattttcatagaggtgtttatagtattctctgatggtaatttgtatttctgtgggatcggtggtgatatcccctttatcaatttttattgtgtctatttgattcttctctcttttcttctttattagtctggctagcagtctatctgttttgttaatcttttcaaaaaactagctcctggattcattggtttttttgaagggttttcgtgtctctatctccttcagttctgctgtgttttagttatgtcttgtcttctaggttttgaatttgtttgctcttgtttctctacttcttttaattgtgatgttagggtgtcgattttagatctttcctgctttctcctgtgggaatttagtgctataaatttccccttaaacactgctttagctgtgtcccagagattctggtatgttgtgtcttttttctcattggtttcgaagaacttatttatttctaccttatttttgttatttacccagtaggcattcaggagcaggttgttcagtttccaagtagttgtgcatttttgagtggatttcttaaacctgagttctaatttgattgcagtgtggtctgagagactgtttgttatgattgccattcttttgcatttgctgaggagtgttttacttccaattatgtggtcaattttaggataagtgcaatgtggtgctgagaagaatgtatattctgttgatttggggtggagagttacgtcactgtctattaggtctgcttggtccagggctgagttcaagtcctgaagatccttgtgaattttctgtctcgttgatctgtctaatattgacagtggggtgttaaagtctcccattattattgtgtgggagtctaagtctctttgtaggtctcttagaacttgctttatgaatctgggtgctcctgtattaggtgcatatatatttagggtagttagctcttcttgttgcattgttccctttactattatgtaatgcccttctttgtgttttttgatctttgttggtttagagtctgttttatcagagactaggattgcaacacttgctgtttttgctttccatttgcttggtaaatatcctccattcctttattttgagtctgtgtgcgtctttgcacatgagataggtctcctgaatacagcacactgatgggtcttgactctttatccaatttgccaatctgtgtcttttaattggggcttttatcccatttacatttaaggttaatattgtaatgtgttatttgattctgtcattatgatgctagctggttattttgcccattagtttatgcagtttcttcttagtatcgatggtctttactgtttggtacgttttgcagtggctggtaccagtttttcctttccatatttagtgcttccttcaggagctcttgtaaggcaggcctggtggtgacaaaatctctcagcatttgcttatctggaaaggattttatttctccttcacttacaaaacttaatttggctggatatgagattctaagttgaaaattctttactttaaggatgttgagtattggcccccactttcttctgacttgtacggtttctgctgagagatccactgttagtctgatgggcttctctttgtgggtaacccgacctttctctctggctgcccttaacatttttttcttcatttcaaccttcgtgaatctgacgattatgtgtcttggggttgctcttctcgaggagtatctttgtggtgttctctatgtttcctgaatttgaatgttggcctctcttgctaggttgggtaagttctcctggataatatcctgaagagtgtttttcaacttggttccattctccctatcactttcaggtacaccaatcaaacatagagatttggtcttttcacatagtcccatatttgttggaggctttgttcgttccttttcattcttttttctctaatcttgtcttcacgctttatttcattaagttgatcttcaatcgctgatgtcctttcttccacttgatcaattcggctattgatacttgtgtatgcttcacaaagttcccttgctgtgtttttcagctccatcaggtcatttatgttcttctctaaactggtaattctagttagcaattcctctaaccttttttcaaggtttttagcttccttgcgttgggttagaacatgctcctttagctccaaggagtttgttactacccaccttctgaagcatacttctgtcaattcatcaaacgcattctccgtccagttttgttcccttgccggcgaggagttgtgatcctttgaagagaagaggcattctggtttttggaaatttcagcctttttgtgctggtttttcctcatcttcttggatttatctacctttggtcattgttgttggtgacctttggatggggtttctgtgtggacgtcctatttgttgatgttgatgctattcctttctgttaggtttatttctaacagtcagacccctctgctgtaggtctgctggagtttgctggaggtccactccagtccctgtttgcctgggtatcaccagcagaggctgcagaacagcaaagattgctgcttgttccttcctctggaagctttgtcccagaggggtacccgccagatgccaaccagagctctcctctatgaggtgtctattgacccctgatgggaggtgtctcctaggcaggaggcacaggggtcagggacccacttgaggaggcagtctgtcccttagcagagcttgagcactgtgccgggagatccgctgctctcttcagagccggcaggcaggaacgtttgagtctgctgaagctgtgcccacagccgccccttcccccaggtgctctgtcccaggaagatgggagttttatttataaggtcctgactggggctgaggcagcattttgtttcctttttttgtcttggagtgttcattctttattcttcactagactgaacttagttcttaatcgttcttttatcctcaatatattaatagactcttgctatcataggtccttatattgtgagttaagtgaatgaattgttgctaccttgggaattactgctcaatttttgttttccttctaggacctcgactggattttgatcctgacattgttgcagctcttgatgatgattttgactttgatgatccagataatctgcttgaggatgactttattcttcaggccaataaggcaacaggagaggaagagggaatggatatacagtatgtgtggtttgtttcaaagcagagatgatgacctaagtgttactgcttcagtgggatggtaaccatagaacgttacagttggaagagaccttcaagagcatttaatctgagacttctgtattttagagcagaaaatgtgagattcattgcttttcctaccaaaccagattgatcaaacaccctcactcttcctgcctagacaagaacccttcctgaaataccttccaattttacttgtgtaaagtggttttgttctgttactttttaagttgttttggtaggtaatttatgacctttactttaggaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtggacagcaatcgcttacaggaagttttgaatgactactataaagagaaggcagagaattgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttct

SEQ ID NO: 515 - DNA, 2995 bp, Homo sapiens
tgtttttattcaggtgataattcttcccttttttatattgttaattttcctcaaatagtaggagattcttgattattcagtctttttgtgtaacaatcctcaatcagaagcttaaaatgcagtaattcctgtgattgtggggagagcaggatgcgcgttcagacagcgtgcccatctttctagaggtgctgttgttttctagggttcattgcttagcactcacacttgcaaccatggcccatcccccagggaattcctactttgttcattgcacaaagctttcccaaactcccttgcagaccctcatcacaggagaagttatttatgccatgttgttccatctcctattactgttttcttcattttcatgtgacttgtctcattataatatcattaacatgtagaaggtgtcggttaactagggtaaaggtgagcaatgtctgcacaggatctagtcccagcagatgctatgctgtgttaggttgaactcagctgttagactcatctcattctgacggtcccaagaatgaaatcactctgcagcctcctccttatgactgtgtgctggttgttcttggtatctctcctgaattcactggctcaacacattctgtttctactaatataagaaatatttccaaatcctctgacagaatgtcttctatatacatttttctcttctaagacagttggttagctttctgctcagtatggactccccagtaattctgagtctcgaaagtgcttatgtgctttaaagtcagattgaaggtcagtcagtgtggctgaaatacagtgaatgagggagagtatcatgaaatgagactgaagaagtaggcaggggcccaatcatgcaggacatcagaggactagataagcagtttgtattttatcctaagtgcaaagggacttattacctgatgcatgtcacagccagctcctcttcctagttagcactggggctgaggaccaatgagaactccctctaggaggtgccctgctgcacacagtggatggcagacctatatcctgggtgctctaggcatcaatcagcggtctcaccaaccttcattctgtttctcttctgtttcagaggttgtgttttcatcttaccctggattttcaacctcagaggtgaaaagcgaaatcccaaaggtgccaaagcagcctctggtgctccatcacccgcgcatgaggacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtaaacatccagctcactgaatgtgtaaatggcccctgagtaccgcccacaattacagatgtggctgtcaccttgggaccctctgagggccatgctttcccagcacccccagatgccccccagcctgttgctgtgactgtatgaagttaggccaggaaagtctgtgcataaacctgggataacaccctcctccatgaccttctgccaggcccagagaatcccgattccacccccaaagaagactagagcccaacttctggatgacatcttcattcgcttgcgggatccccggaacattacagaggctccactaggtacggctctgccacagctgccaggatcccagatccagttcacgcctgctggctaaaggcaaagaaagggcttgtgtcagtgcaggaaaggcccttagagagcaactgcctacatcagtctctacatgtagatggacaaaaggagagccagcgtgaggcagggagttgcctaaaatcacacagcatgttaaggtcctgaaccagggcttaagatagagtcaatgcataggggcagtaggaagtcagtgacttcccaagctggaaaggccatttttagccccttagcatcctcctgccacaccatcccattttccaagggtctctggacccaatcctcttgcttctggctaggtgagaaccaggatgagcttggtgcctctcctggcttcttttcctgcaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggc

SEQ ID NO: 516 - DNA, 2552 bp, Homo sapiens
tttgacataagatggtgagtttccattttaatgattcgttttgtggagacggggaaccgagctctctggctctgttatcttcagatgacctgttgtggtcaggggagacttcatttctaccagagcaagaaggtaggagattgccctgctatctcagcaggccagaagaggaactctggaggctaactgaaccaaatcagttgctggattataaagccattgtgcgggggctggggcctctgcctatttcccaagaggaaaggcattcacctggcaaggggtggcttccccctatggggcagggacggggtctgttacagttgaccttgatgcattctcaaggttagatgagaaggacgtagatttccctgaagcacgaaagggtgtttggggagagaagggggcagtttttggctctgggatggttgccaagagcagacataagaagggtccctcgaggcaccacgggtgcatcacaggtacaccccaaaggttcctgagagccctgaggcaccccacggatggccatcagcagcctccgtgggagggtgcagccacgcctttgttcctgttttcagggcagacacgtttttccagcaggttgatacgctcgtgtggggcaataaagaagcttgacccagggcagtggaggggaaacagggataaattaagaatcaaaacggaggccgggtgcggtggctcacacctgtaatcccaacactttgggaagccaaggcaggcggatcacttgagatcaggagttcgaggccagcctgtccaacatggtgaaaccctgtctctaccaaaaaatacaaaaattagctgggcatggtggcaggtgcctgtaatcccagctacttgggaggctgaagcaggagaatcacttgaaccagggagggggaggttgcagtgagctgagatcttgccactgcactccagcttgggtagcagaacacggctctactcaaaaacaaaacaaaacaaaaaaaaaaacagtttcctgtggaccctatatgtcttccattggcctggcttctgcccgactcctccaggctgtgtgggtggagttgaggctggtatggatagatctccacccttccagaaccctaagtgcccagaaaagctgcgtctctgagttgccgcttacccgccgagagcctcgtgcgagctgctctgcccccctgcccctgtgaagtgggtgtgcagtggctgttggattgcggccctgggttaaatgagtcagtacctggaaagcgctttgtcttggaggattcccatgaaagtgtgtgttttaacaaaaggactcactgctcttgtgcccacacctgtctattaaagccatggtagtggggcatgagcctggacctccatcaggagaagcattccatatttctcccacgtctcctcttttgcattggctctgtaatctgctcgtggttcggtcatgatgggcttttctatgacacattgagttgcttcttcatctcctggtcacctgacagcacgaactcccaggaggcagcgcagcccctggcatgggggcagcccacccactgccgctcggtatgtctccacaggctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaaccgtgagtgggtcggggaggtgggctgggtgcagggagggaagctggcagatccccaagggcatttgaaagggctgcataagactccgctggccactctaaaatctactgctggaaggagctgctttggggagaacagagcttcagttgagagcatctgtggagcccgccttagagggcactgggccttcccgcctccccctgcccctgccccggcccgggctgcaccatgattccttccgagtcctggtggcccagtctttgctaataggtagactgcttctgtgtgattcatcacatgaccaagaagaacaaaggattgtctctttcgagtgacattaagggggaaataaatccgttttgtcacccttgcattagggccctgcttttcagcagatgttcccgagttcatcagcttctctttggaccaaagaatttctcagtaaaggttaaaaataatctggccgggtgcggtggctcacgcctgtaatcccagcactttgggaggctgaggcggtcggatcatgaggtcaggagttcaaaccagcctgaccaatgtagtgaaaccccatctctactaaatatacaaaaaataattagctgggcttggtggtacacgcctgtagtcccagctactcaggaggctggggcagaagaatcacttgaacttgggaggcagaggttgcagtaagctgagatcgcagcactgcactccagcctgggtgacagagcaagactccatctc

SEQ ID NO: 517 - DNA, 2524 bp, Homo sapiens
agaggtcctatcgctcccagcggtttccgcagccacctccaccacctccgcagcaaaacgctagccggactggagggccctcgccggcgtcgtgctgacgtcacgcgcgtgctgacgtcgcccgcggccgcggcctctgaagcgggctggggatcggggggcgccgagtttgactagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaacagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcac

SEQ ID NO: 518 - DNA, 2613 bp, Homo sapiens
gacccggtcgcagcgcccggggcggctcctcctcgagcctgggaccgccgcgctcccgccgccgccgcgtgctggcgtgactcccggcccgtgccgcgccctcccgcgtccgcagccggctcggcttcctgcccacccagacgtcgcttctcccgggctcccggtgtcggctccgcgcggagggagaggaaatgagtgcggcggcctcgccggcgtcggagcggggttggaagagcgagaaactagatgaggctcaggccctggcgcggagttgcgccgcccgcagacccgacttccagccgtgcgacgggctgtctatctgtgccacgcacagccatggcaagtgcttcaagctgcactggtgctgtcacctaggatggtgtcactgcaaatacatgtatcagcctatgacccctgtggaacagcttccaagcactgagattcctgccaggcctcgggaacccacaaacaccattcagatctcagtctcgctcaccgaacactttttgaaatttgcatctgtcttccagcctccccttccccctgactcaccgaggtactgtatgatttcagacctttttattgacaactatcaggttaaatgtattaatgggaagatgtgttatgtgcagaagcagccggcaccacattcccacagaatgagccctgaggaggtctctgcacacgatgccttaatttcaaaagagagcaatacaccaaaaatagatcactgctcttctccctcaagttctgaggactctgggatcaatgcgattggggctcactatgtggaatcgtgtgacgaggacgcagaagaaggagcagaactgagttcagaggaagattacagtccagagagcagctgggaaccggatgagtgcacccttctctccccctcgcagtctgacctggaagtgattgaaacgatagaaacgactgtgtgagagtccagacaggaagccacagcctcggacccacgccgagcttttgtacctttgtctggtggatccttttttccaatgctgttgatattttctacccaccccgccccgctccaaccaacaaccgtagcagttcagtggtatgctgattagcttctctccgtcttacaactaagacattctttttattataaacagttttcttttgtatcctgacttactttctatgtagcatctggtgtcatgaattgtgaccccgccttaatttcactgggagatttgaaggcggtgaagtgatggtcgcagagaatcttggatcagattgaggaggtaccgaaagggaaggagccggtgttttctcggtagccagtccttcacagagactcttgccattccctttggcatgttcacaggcactcccgtcctgtcctgcttgtcctacgcaagtagcactccctactgagtgtgcactggtagatgccgtttcttcccttccccttctccccacacctgcactgggtctggatcagagctgcctcggcttacttctgggaggtcactggaggccagctcagcccatggtttgtggccagtgtctgtacaaggctccgtgactggggctgagctaaacattcacatgagaagagatgacctcatctgtctcatgctcaatccagccttagctgagcacctgtcccctgcagggggctgtggggacacagcatgaataagacctgattcccaccatgaaggggcccacagtcctatatatgacacattcaactcatggcacccaaaaagctctgggaacccaggggaaggatgaggtttacttggctggggctagctggggaatgtgtttcagcatttgagctggcttcttggtgggttccccaacatttttctgcttttaattgttcttcaagtctgggaaaaaaaaaaaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccagtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaacc

SEQ ID NO: 519 - DNA, 3342 bp, Homo sapiens
catggctgaggcgggatgtgaggcccaggtcccctagctcctgctccctgtagcagtccccctcactcacacaagcacccagtctgcccctagatgaaggcagaggtgactgccaacagccaccaacaggcgacactcaggccagcacacaagctgtgggtcactgctgtgttcctcatctctgcctgtgcagactcagccctggcctttgggttctcttgcagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtaagtgcagtgtggcgccatttccaggcgtacctgtggtgtctgacaggagacagccacgttgtaggagtggccacctgtgggcctggtccctgagcctcagggccaaggtcccggcagggcagggcagggcagggcggccaaggaggcacagcctggggctgagctgctccacctgggagcccgctgaggctgttcttccctggtccaaaccccgaaaacagaaaaacagaccaccgccctcccccagtgctcggtccactacttctttctctgagccactgggtgagtcgtgggactgaccatgtgactctctcagctttgctggcgaaacgctgcaggagtttttgtgtccttctcagccgcctctgtgaggtgactggggtgaagcagctcgcacaggtgggctgcagcgtggggtgtctcgagcctttccctggctccattctatgtttgaaactgtatttgtttaccaatttttttttgttctttttaagatggagtctcactgtctcacccaggctggagtgcagtagctcaaattcggctcactgcaacctccacctcccgggttcaagcgattctcctgcttcagcctcccaagtagctgggattacaggcatgcgccaccatgcctggctaatttttgtatttttagtagagacggggtttcgccatgttggccagggtggtcttaaactcctgacctcaagtgatccgttgccttggcctcccaaggtgctgggattacaattacaggtgtgagccaccatgcgtccctgtttactaattttttaagcttagtttttgatgctttacacatttgggaacctcgttacttcctggaccagaagtggtacaaataagcaagttttatacacacactttttttttttttttagacagagtcttgctcaggctggagtgcagtggcatgatctcagctcactgcatccttccacctcccgggttcaggtgattctcctaccttagcctcctgagtagctgggattacaggcatgtgtcaccaccctagctaatttttttgttttttgttttctgttttttttttttttttttgagacggagtcctgctctgttgcccaggctggagtgcggtggcatgatctcaactcattgcaacctccgcctcccgggttcaggtgattctcctacctcagcctcctgagtagctgggattacaggcacccaccaccacacctggctaattttttgtatttttagtagagatggggtttcaccatgttggccaggctggtcttgaactcctgacctcaagtcatctgcccatctcggcctcccaaagtgctgggattacaggtgtgagccattgcacgcagccccatggctaatttttgtatttttagtagagacagggtttcaccacgttggccagaccggtcttgaactgctgacctcaggtgatccacctgccttggcctcccaaagtgctgggattactttgggatcccggtgtgagccaccgtgcccggccaggaaaaaaagcattcaagaaataaagttgtggttaaattaatacgcttcagttccactagtgcactgttagaaaaacagtcctccactaacgtgaagtcaacttgaaataaatatgaagtatttaggtatttgcctaaagttgcaaaaagacctaagaattgttttacttaaaagaaatggtatagaggccaggtccggtggcttatgcctgttttcccagcactttgggagaccaaggtgggaggatcacttgagcccaggagttcaagactgacctgggcaacatagcaagaccctgtgtctatttaag

SEQ ID NO: 520 - DNA, 2482 bp, Homo sapiens
tttcggatatgcatttcattcatccatgcgtccgcctgcctgcctgcgcttccatccatccatccatccgtccgtccatccatccatccatccatccatgcatcctatttccagcgagacgtcagagaactcacagtcttcttggggaagaggtcataaacttgggcctgggtggttgccctatccaactgaggtcgcctttgcgatccctgctgcaaataggcagtgactagtccaggagtgcagctgggaggaactgctcgccggatagaagggaagaaaggagattctaggcagaggctggaatgcaatgatgcgatctcggctcactgcaacctccacctctcggcttcaagcaattctcctgcctcagccccccgggtagctggtattacaggctcctgccaccacgcccagcaatttttgtatttttagtagcgacagggttgtaccatgttggccatcctgacctcgggtgatctgcctgccttggcctcccaaagtgctgggattacaggcatgagccactgtgttcagttggccatactgatagactccaggctttgggaaactgatggcatttggggatttccccagcatgtcctgtgatgctcttgattccttgtgtctccagtcatgacagagagaaggcattcctggcttgttggtccacatttatgatttgttgatgttgttgttgagatggagtctcaccttgtcgcccaggctggagtacagtggcgtgatcttggcaacctccatctcttgggttcaagtgattcctctgcctcagcctcccaagtagctgggattaaaggggcgtgccagcatgcctggctaattttcatatttttagtagagatggggtttcaccatgttggccaggctggtctcgaactcctgacctcaggtgatccaccagccttggcctcccaaagtgctgggattacaggcgtgagccactgtgcctggcctgtgatttttttattttttcagaaggggtctcgctctattgcccaggttggttctgaactcctgggctcaagggatcctcccgcctcagcatcctgagtagctgggactacaagtgtgagccactgtgccaggcacaatggtcttttgtagtggagaacctcctccctgggaccactggaagacacaggccaagttattgctgataggaaaaccaagaggtccaacagaacccaagatggatcggatggaagatggcacaggtgcccgggacgtgcagcactggagtgggtgatggatcctggaatctctccatccctttttggagtgtacattctgcagtgagaaacagtgccccagcacaagtactgatgagctctccactgccgaaatacaactctgtgaccatggccagcaggaagccactgatgaggggaaacacagtgtgacggtgcccagggaaagaacctgcttctttgtgacatcacggagctgctgagccgcttgaacttggagccactttgagttgggaattctggcttttttgcagctgaaagtgtgccaaccccgtacaagaagaacagctgcaggtctgcatgtggcggctcgcgccaacactttgggaggctgagacaggagcatctgcttgagcccaggagttcgataccagcctgggcaacatagtgggatcctgtctctacaaaaaataaaagtgatgagaagaatagccctaaaatcatgagagtggttgcccctcgggacggcaccaaggaaataggactggtgcggggagtataataggaattcatctttatctgttatcctttgtctttttattttgagacggagtctcattctgtcacccaggccggagtgcagtggtgtaatctcggctcactgcaatctctgcctcctgggttcaggtgattctcctgcctcagcctcccgagtggctgggattgcaggcgcacgccaccgtgcctggctaattttttgtgtttttagtagagacgaggtttcaccgtgctggccaggctggtcttgaactcctgacttcatgatctgcctgccttggcctcccaaggtgctgggatcacaggcgtgagctaccaagcccggccctatcttttttaaaattaaaaatatctgacacacgagccaggtgctgtggctcacgcctgtaatcccagcactttgggagactgaggagggagaatcacttgaggccaggagttccagatcagcatgggcagcatggtgagacctccgcctctacgacaaatagccagatgtggtggcacacacctgtggttccagctactcggtaggctgaggcagaaggattgctggggcccacaaagtcaaggctgcagtgagctgtgatcatggcactgcactccagcctgggcaacagagtgagaccctatctcagaaaagaaaaactctgacataaatgtgataaaatgttgacactgtttctattatagctgtaggtgtgtgcacagtttac

SEQ ID NO: 521 - DNA, 3438 bp, Homo sapiens
agcgtgtgctccgagcatgtgccagcctccacaacgtctgcgtcccccacaggacggctctgcattgtcccctcccatggctccttgtcgtcgcggggctggcgatgccgaagccaccctaccaggctccctgtctcggctctccttccccatcgctgcctggctctgcgctgaccacggggggagccccgaccaccccagcctctcatctaaggccccactgtcaggcttagcctcagcagcctgtggctgcctccctcacctcaccattcccttggcggggtattctttggggacacccgacatgcctggcttgttgcagcttctgtgctttttcttttttgagacagggtcctgctctgtcgcccaggctggagtgcagtggtgcaatcacagctcactgcagcctcgacctcctgcgctcaggtgatcctccagcttcagctacccaagtagctggaactacaggcgtgtgccaccatgtctgactaatgtttgtattttttgtagagacagggtctcaccatgtcacccaggctcatcgcgagcctgtgcttcggtttcttttgatccttctctcttgatgtccttggcttccaaaaggattctgtggttccgagggcccctgaaggccccctgtggcaggagtttccccaccactccccagggcatctcccatctgcacgcctctcggccggagcttcctgtgccctgtgcccctggatgggtgctctttgcaggtaggggtggtgcacgagtgaccctcaacttccagcctctgagcactgcatggcagctggtgggcgggcaggatctgctgggctgggttgtcctgggtcttgcacttgttgtccatggtcttgctgagggtccatgtgtgacccttgtttctctacgtggaagtacatgagaagcacaaacgcagggcaggggatcacaggcgagtgggattcctcctgcgactgccccgagccacatgtctgcatactcagacctgcctacaggtacctggacagctctggaaggtgctcacaggtgcactgcggggagaatctcggggaaggaacagtatgggggactggggtgcaggtgaaggaggctctcactttttaatatcaagcctgctttcgtgtagtatttgtatagctgtaaaataatattgttaaaaataacatcctcatttaaatacttttttcttttttttttgagatggagtcttgctctgtcgcccaggctagagtgcagtggtatgatctcagcttactgcaacctctgcctcccgggttcaaacgattctcctgcctcagcctcctgagtacctgggattacaggcgcgcatcaccatgcccagctaatttttgtatttttagtagagacactgtttcgccatgttggctaggctggtctcgaactcctgacctcaggtgatccacctgtctcagcctcccaaagtgctgggattacaggagtgaaccaccatgcccagcctaaagacatcttttaataggttaaataatagaaagtccttttaggaaatgccactgctctctgtcccctgtgctccgtgacttgcccacctgcctggggtgtgggtgggaggctggcccggacccctgcctggaggcctccgtgtcctcagccccagctgcgtgcatttcttcatgcgtcccctgcacacaggatgcaccgtaccacgtgcccggctgtgggctgcgtgtgtggtagggatgtgcaggtccccgggtggcgaggggggttctgagttcccgggaggacatggacagggaaggagatgcaggagagacacacacagggcctgtggggattccagggccagagctgtcaagctcggcggctggagctgaagatggggcgggctgtgcggcgctggtgacgggcgccgtggcctggctggggtgctcaggtaccagctgcttctcctggctgggtctggctcggtctcagcacgtggccaagccggcagcacaagcacaggccttggtcttggctgggagcagggctggccctgccaggcaccagatcagagccaggagcgcgctggcaagccccgcgggacatattgtgcatcagctaccacggcagcccttcccagacgggcctctgctcgcctggggagatggtggcggaatgcggaggtgcccagccctggccactgccccacccctgcactctgacctgccagtcccagaaatgtcctctcagagccctggagtcagcgggcgctttctggggagctttgccttctcccctctccccatctgtccctgactattggagtcagtgcttgtgtttgagcccccgaatcaaatagctttgcaatttgtcaaattatgcagaagagacagaggagaggaaagggaagtagtttggttctattatgtggaaattagctttgaaacagaggccgtttgcctgttagagcaatttctctccatttatttctagagaaaattgcctgtgtggctcacatcctcatctggtggggctggctgtctcccaggccactaggcatgggggctggaggcctgcaccagccctgagggcgtctccatcctggccagggaatggaagggagaccaggaggcttcatgctgctgcccctggccctggggcaggaggggagggggcaggctccggctcactgcccagcccccatctacctctgagacatgtcttggtggctcttggaaggccaggtccccagctccctagaggatggacctggccaagcctcctggatgggggtgggaggccctgcctgagcctgaccttggcgggagagtgctgcaggtgatgctgggatgggtgggaggggactccaggaggagggaccagctgaaggcaccacaaggccctgtgtttgggaaagggcagaagtcaggcaagacctagaagtggcaatcccaactgcattttctatccttccaggtggagctgccacctgtctgcggatcccagcccggccagccagctctactgcggggcacactggggtgtctcggggagactggcagagtgatggctgcaggctgctgcccttcacggagcctcctgtggccacactcgtggggtgcccgtatctgctgcctgggggtccctgcacgagccctctgggaggcatgcgggctccagggttccagtggggagcttgtagtgtggtgaggggggacctgctagggccatgcaccactggagggcagcagccccccacccctgcaaccctgtctgctgctccggagctccgagcaaagtgtacacctgggcatcctgaaggagactcaaagccaggacgctcgggtggggtctgagtgcaacatcacacttggccgtggctgaggggagagggcagcccttttgtgctattatcatattgttttggggaaattgctttttatgaaataaattttacataaagtg

SEQ ID NO: 522 - DNA, 3335 bp, Homo sapiens
aatataaatgtgatgtatgtggcaaggtctttaatcggaagcgaaacctagtgtgccatcgtagatgtcacactggggagaaaccttacaggtgtaatgagtgtggcaagactttcagtcagacgtattcccttacatgccatcgtagacttcatactggagagaaaccttacaaatgtgaagaatgtgacaaagctttcagtttcaaatcaaaccttaaaagacataggagaattcatgctggagaaaaaccatacaagtgtaatgaatgtggcaagacctttagtcagacgtcatcccttacatgccatcgtagacttcatactggagagaaacctttcaagtgtaatgagtgtggcaagacctttagtcggaagtcatcccttacatgccatcatagacttcatacgggagagaaaccttataagtgtaatgaatgtggcaagaccttcagtcaggagttaacccttaaatgccatcgtagacttcataccggagagaagccttacaagtgtaatgaatgtggcaaggtttttaataaaaaggcaaaccttgcacgtcatcatagacttcatagtggagagaaaccctacaagtgtactgagtgtgtcaagacgttcagtcgaaattcagcccttgtaattcataaggctattcatattggagagaaacgttacaagtgtaatgagtgtggcaagacgttcagtcgaatttcagccctcgtaattcatacggcaattcatactggagagaaaccttacaagtgtaatgaatgtggcaagggttttaatcgaaaaacacaccttgcatgtcatcatagacttcatactggagagaaaccttacaagtgtaatgaatgtggcaaggtttttaatcgaaaaacacaccttgcacatcatcatagacttcatactggagataaaccttacaagtgtaatgaatgtggcaaggtttttaatcaaaaagcacaccttgcacgtcaccatagacttcatactggagagaaaccttacaagtgtaatgaatgtggcaaggtttttaatcaaaaagcaaaccttgcacgtcatcatagacttcatactggagagaaaccttacaagtttaatgagtgtggcaaagcttttaattgaaaagcaaagcttgcacatcatcatacaattcatactggaaagaaacaagtgcaatgagtgtggcaagaccttctgtcacaattcagtccttgtaattcataagaattcatactggagagaaacaagtgtaatgaacgttgcaaaatttttaatcaacaagcacaccttccacgtcatcatagacttcatcgtggagagaaaccttagaaatgtgaagcatgtgacaaagtttacagtggcaaatcgagcctcaaaagacaggagaattcatactggagagaaagcttacaaaggtgaagaatatcacagagttttcagtcacaagtcaaaccttgaaagacataaaataaatcatactgcagagaaaccataaaattgtaagagttcgtgacaaggctttcgggcatgattcacacctggcacaacatcctagaatttatactggagagaaaccttacaagtgtaatgagtctggcaaagccttaatgagcagtcaacacttactcaccatcaggcaatccatggtgaaggaaacttgactaatgtaatgattgtcaccaagtcttcagtaacgctacaaccattgcaaatcattggagaacccataaggaagagagatcatacaagtgtaataatcggcaaatttttcagacatcgtccataccttgcagttcattggcgaactcatactggagacaaaccttataaatgtcatgattgaggcaaggtcttcagtcaagcttcatcctatgcaaaacataggagaattcatacaggagagaaacctcacatgtgtgatgattgtggcaaagcctttacttcacgttcacacctccttagacatcagagaatgcacactggacggaaatcttacaaatgtcatcagtgtggcaaggttttcagtctgacttcactccttgcagaatatcagaaaattcattttgagataattgttctaaatgcaatgagtagagcaaaccatcaagcagtaattgacattaaagtgtttatgttaagaggattgggccaggtacagtgtctcacacctgtaatcccagcactttgggaggccaaggcgggtagatcacttgaggtcaggagtttcagatcagtctggccaccaaacatgagccacttttcccagtttgctttttgttctttaacaaaaactgatagggatttttatgggtaccgtgttgaatctaaatcacattgggttatataatcatttaacaatattaatttttccaatccatcaatatgggttatatgtctgtatatgtttttaatcatattgatgtatatttgtagatttcaaggtacaaacttctcacctttttacttttatttctatttaagttctctagcaaattgaagtgtttttaaattttcttttaaaattgtttattgttacaaacttctcatctttttgcttttattcctaagtatttcttactttaagttctctagcaaatggaagtgtttttaaattttcttttaaaattgtttattgttaatgtatggaaattcagctaatttttggtgctgatattgtactgtgcagatacactgaatctgtttattacttccagtagtattttggttgagtctttgtgattttctacacagaagatcatgtcatctacaaacacatataattttacttctttctttctgatttggatgggtttgatttcttttgctatttcattgctctggctaggacagccagtatttattgaatagaaagggtgagagcattcttccatcacgtgagatcctacaggaaaatcattccatgttccctgcttcgttatctactcgttggtcatttcatggatggcctttctattgttgaggtaaatttccttttctgtctattttgttcagaatttctatgatgagtggattttgaattttgtgaaatactttttctccatctattgagatgatgtggttttcatctttcattctgttcaagtggcatatcacattgatttgcttgactatgttgaaccatccttgcatcccagaaataagtggcacttgagtatctacaatcctttttacatcttcttgaatacagctttttagtacaaggggtcttcaagaagttcatggaaaaatacatattttgcatattatgagaaaattgtgtatgaatttcccagtttttgcaccaaaataaactggtacgaatctgtt

SEQ ID NO: 523 - DNA, 2697 bp, Homo sapiens
tacatgggactgaattcttgaaaagagccatcaaattagggataatactaaattgatactgtgcaggtgttctccagtgatattctactaagaatgctaaggttctggtcaggaactataaatagcagattaccaaacactgctttttctgtgatgataaaagcctcataagtaacaaaaacaatgtttaatttagactcctgtaaacaggatgcaattagtgattttttttaattgggttcagtaacttccagtaacaaatgtagtcaacaccaaattagaatgtgagcttccttacaatttttgtacatagactactatcatctaattgcttaaatatatatgctggagtaaaaaggtaacttctgcaaacttattgattttaagagaaatacccataatatccttcaaacccaatgaaagaagaggcctttacgaaaacatggcttgtgatttgggtggattatacttcctgggaccttggccctcccgtgtctccagaagagacgtgtgtcccgagacacatgagtatcctccaaggcactggcctggatgagcagcatcgccttgagaattggggtagtgtggaaaggaagaatgaacaacggccctgggaagccttcccttcctgcagatattgttgggggagtgctggtctccattttgcgtttagaaaaccagacttagatgctggaggggcaccggttgtcttctttgaactcattccccgtaatgagctagaaaagagtacctaaccataggtattctctctagagactcatgtgtcccgtgggtacagtcaattcacagtatctgttctggcttttttcactttaattctgttctgcacattctgaacatatgcaggaaaaaaaatcattcctgaacttagcacaagctacactcgacacaacctaaattagtaaaaagcctttgacttattttgaagcaatttaactgtagacaaagcttgcatatatggaacagtattctcagagcctgagagttgttacagttgttctatttggaaattagaaggaattttttaataaggcacatttttcagtttcttacccattggtgtctattaagaatactatgtaatgttgaaatttccatcaaattaccaagcaaattactattaatgattagagatttagcctaacactctctctttgggccttaaatacccatttgtagttgtgttcgtgtcacttctgtctcagatgcctctgccaggacataatctctctaactcttgctagctggcttctccctcccacatgggcatacatgctgtgtatacacagagtacagcctgtgtacacagtagcagctgtcaacagggcctactccagatgggtggccccaggtaatcctctgctgtaaagtggctagaacaggctgtccctgcattaaaataggtgagaataaggaatttcgcctctgataataatatttattttcatgactttagagtaaccacatgatttgtaaacagttaaatgaagcagaggcctgagagagttgttggcatttgtctcacattaaatacattaaaattgctagatttgctattgtggttatgtctatcaaaactttaagaaaatttgtttaatgtactgagtttaactgattttctttggtgctgggaccaaattcttcacttctacaacactcaagagattgtcacaaaatattacaaaaatattgtttgttttgtggctcattaaaccctatataactaacagcttttaaggacattaacagaaatatatcttcagatggataaataagatagggacctattcaagacagcagcatttttgtattgtgatacctcccctaagttactctcacaataaaaccttatttgagaattttccttcacttcaatctgtgacatagcattaggcatttagtataccttatttgtgaaacctaaggttcattcaacagatgaagctgcaaaacagttttcttggtagactcttggaacttgctcagttttttccttactttacctgcatgacacacattgggttgaaagttgtttggttttacccttcatttctcttagatatgatttggttctttttcatgcattatatttttgaaatatatggaggaaatattttattgaatcaagaaatagaaaatattccttaaaccagtagtaaaaaggtgagttagaactccatgtctggaagacaattcaacatttaaaatattaagatgctataccacttaacaagtgaatactaaaatttttaatttaaagattgattgttctgtttttatgaccatgagaaaaatgtgacagcttcagctgtcatatgtttatcttgaatgcttttctaattatgtatttctggattattgactttgaatgccacagaccaactactttacatagagtaaaatattgattaacctttgtgctttgggtcactggcaaaagttgaacatcctgataagtcaatgttaaccagaaacctttttgttcacgtctgaaattgaatatttataaaatgtgttagtatgtttcctgccttgataagttcacctatattgaatgtaatttgatctttgataattttttttaatcttgagaattctctgatactgttttgaataccagtgttcaccatgttataaagttaaacataaaaattgaaataaattgaactaaatatg

SEQ ID NO: 524 - DNA, 2194 bp, Homo sapiens
aaaaaataaagccgcagctagaagatgaacaacaaagaaagatgggtttaggcgctatcgaatggtgtgtgtatttgttcctttttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggatggcagatctgatgcaggagacctttctgcatcatgccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatacagaaaaatgtgtgaaatgctcaaagtttcaaatacagatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcgggatatcgagaatcagctgcatttttattgcgatctgcagatgaactggaaaatctcattttacaacagaactgagacagacgaccaccatattcactgaggtctaaatttgcagttcccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggc

SEQ ID NO: 525 - DNA, 2847 bp, Homo sapiens
agacgcgcctccaccgccgggcagtgggcaggtatggctgagggcgtgtgagcgccgagcgctaagggccgccgccaccatgccagggggcgcaggcgccgccccgctctgcttgttggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataaggtgagaccagttttaccgatccttgaacatccggattgctctcgtgggcttggaagtgtggacccacgggaacatgtgtgaagtttcagagaatccatattctaccctctggtcctttctcggttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccagaagtgccttttgcctcctgccatgattctgagggctccccagccaagtggaactgttgtttgcttagtaattagttttaatatggccttctacaggtcaatgaggattagaatagaaccaggaatcaagaccaagttgctggttttactagtttggaagcagttttaatgaagatggaaatgtttatcaactcaacacagacacacac

SEQ ID NO: 526 - DNA, 2630 bp, Homo sapiens
ggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcg

SEQ ID NO: 527 - DNA, 2821 bp, Homo sapiens
atcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagag

SEQ ID NO: 528 - DNA, 2765 bp, Homo sapiens
aggaagtagggggctgggaatccgggactgtgggggcaagttgacggctcccagggtcgtcggggctgagccgagaggcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagtttttggagcctgtgggcatcatctacaatcccgtggagtatgcatgggagccacatcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctgtactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaacagggatgcctaccttatggggttggtgtgaggattaactgagatcacacttgaaagtgccttgcatgggcttggcatgtgggtgctcattacatagtcttcttgttttcttgcctctgggttgaggattcacagcactgcactacaagggtagcccctctccattctggataccttgctaggagagagtctgggcttccacctgcggccagggtgaagggaaaattcttgccatgtcagagatggatcaatgactatgaaaaaactagcctgtgattttttttcactctaagcattaagagctcctaaagccttttgtcttgttacttttttccccctcttgcatgctagaggtggaaggtagtcatttagatttcccccctcttccctcttcattgttggccaggggttctcttgggcagctgggggaaggatgtagtagatctctcttttttttttttttgagatggagtctcatgctgttgcccaggctggagtgcagtggcatggtctcagttcactgcaacatctgctttcccggttcaagtgattctcctgcctcagcctcctgtatagctggaattacaggcatgtgccaccacgcctggctaatttttgtatttttattaaagacagtgtttcaccatgttggccaggctggtctcaaactcctgacttcaagtaatccacctgtcttggcctcccaaagtgctgctgcctggctggatgtagcagatctccaattgccttaccaaacctgcagggtctctgttaagtgtctgttaggggtcttatatgatactctggacaccgtgagaaacaggtgatggggcagatgggaacctggtatccaactcattttttatgtctgctgaatggttgactgggtgcccctttggtaagggctgggaaagtgaaccaagttgggagcagagcaggtcttgagaccaccttaatgaggaacacatggtctacttcctatctcctgggacacaggtcatttccagcttccagaattagtaagatttttcatataaatcctcccctacttcattgtataataaagaatttggcctttgtcttcagttcctgagaaggagactctaaatccttggaatttcccaagtaataggagtatctttgtttttcgtggcaggtccctgaaactacacctgaatttatgttgagatttgaccttaggctgcacctaattttatattgaatttgatctcagaccacacctgagtttgctgtaagatttgactgaggatggaggctgaccatgccagaatgaccaaccatatagttacagggctgggactttgagctggatgataccagcttgatccccagggaggggagaggggctagagattgagttcagccacatgccgatgattttaaccaattatatctatggtaaaactctagatataaaaacttctgacacag

SEQ ID NO: 529 - DNA, 2677 bp, Homo sapiens
cagctgtgtgtgctgggcccactgatcagggtgctcaggaccaggagccttctgaggatgtgcagaggggactctgggaagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaagtgctgcctgactgaatcctcagggcaccccggcaggatggacgtggtgtaccccctactttacagatggggaaactgaggcttgagagctaaagcagcccacccagctcccagagatgaggaggccgactctggcaggagtcactgtcggtgcatgggcatttcttcctgttacagcctgcggccccttccaggccgggaggccttctgcgcagggccaccctccctgcatggcctgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcgcctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagctgggcgtggtggtgtgcgcctgtagtcccagctgctcggggaggctgaggtaggagaatagcgtgaacccagaaggtggaggtagcagtgagccgagatcactccactgcactccagcctgggcaacagagcaagactccatctcaaaaaacaaacaaacctccaacaccacccggaagggcctggaggcactcactgatgagcctggaatttctcacaggggacagagaggtggccaaggctcctgcacatttccccatctgtctgacacccctttccagaaccagaaagcgtgctgagctcggcctctgtcacgcagggttccaggtatttctggggctcagcagggagaaggccaggacgtgctccctgactctcggcagggcgggagaagaatgaatcctctgaggtccccagcttggggaaaagggggtgggagagtggcgggcagagacctcctccgtatccccctctcctgaagccctgccgctgtggcagccctacagggactacagggctccagccctacagggactctgcggtggggcgggtgtgcaggctcacaggctctggaaatgccccaggatgccttggcagcgtctcccacagacccaggagcgccactagaaacaggacccttcctcagtcatcctgcatgggggctcctgttgctttgggggctgctttccagcagctgcgtcagacaacgacccacctcatccccccagccaggacctgaacaggcactgacgtcagatacgtagaccttgttgctgaacttgtcaaaaacttcaatggtgatttcatacaggcggccggtctccagcacccacctatcaccagggtgaatggtgaaccctaaaacaggcagggggagcctgagcactcaggcctcaggggcagcagggtggaggaggatgggaccaccaccctcagcacaggggccctcagcatccacatgggaagccccactccacccacctgtaggccccacaccacccacctgcaggccccacaccacttacctggaggccccacaccacccacctaggggccccacaattatggcgctggcctcctccacagagagggacctgttgctgaggaacagatgcctgatgccgccttcagccctgagtcctgagctgacctcccgaggaccaaacctggactcatcccattctatctgaacaaggctccttcaaacttgttcctgttcctcagtgggtctacactcagaatcctagcagctctgtccttaacacacagcaggtctatgctctgaagtgataataggtctatagtgttcacagtagaactagtctgaaccttcagggggtctgtgctctgaggagggatggacatagactccaagaaagtgatgattctggaaaaggaacgcgttgttaaagtttgttgatcaaacccagacacaaggtctgtcagaatctaccacagcattccctatcagcccctcccactggggccaacgctgaagaaataaggggtgtcccgttagtcagggctggggctacctagagacatgtccctgcagcttcctacatcagatctgcccatgtccttgtgaaaaatgcagatgcttggcccctggcccaggctgtgtctgcaagaagcctgggaaactccattttatccatccttgtgaatgtcctcgtctgtttcaaatacagtgcagtcagttttatatgatgtgcaataaaccaaaaaggctttatt

SEQ ID NO: 530 - DNA, 3754 bp, Homo sapiens
attgtgtctgtgtcgaggcgtcgggagggcctaagtccgtgtgcggtgcccttcggccggcctgagccccagagtcagctcccctttctcgcccagcgcccccaggccgctcccggggcccacgctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgccaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaacgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaggactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacaaagtgcgagctaaaactgcacagtggtcattctttggcctctccttggctttatgacttaaaccaactacaacttccctatagcttctaagcagtttcatcagcattacttgggaaaacgtgttgcaagtcacccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctc

SEQ ID NO: 531 - DNA, 2660 bp, Homo sapiens
atagagcctgggccacctgcccttccaaaagcagcaggttaaaggccagtgcccagcacgcaccccaggtgacccctgtcccagagcacaggccatgcctgccctctctgctctactgagacagccactgctgttcccgtgcagatggggaagacgagggacagtcactgctgttcccgtgcagacggggaagatgagggtggaaggtcatgcagcgtgggggggcgggccagcctcctgggacgtggccaccgggcatgctgcttggctgtggcctcccaagatgtgctgctggtgtgaggctttgcacagggcaggccgtggaatgggatgggcctttctcctctgggcgaagtgtttggtttcagagggaagaccaggcagggcttccagttgtgtttcttaaactgctttgatgcaagggtcatggtgaggagttgtcatgttctggaacctggctggctctcagtcctgggctcagagcccctatctccagcctggttttccccaggtgttttcactgggaggaaacaccaggcacacctgtcagctccctctcatgggcagggagagggagtccccagcaccgtgcgaccccaccatgttactggctatcccctctgctgtcctgcgggcttccctcaagggggacccagtatctgaccctgcctgaatgtgtctgtggaggccaggcgccttctgatggccttgcctgccccgccccctgctcccacatcacccagcgatgggattccgacctgctgcagcaccaccccatgcacctgaactccaggcacgtcacatcgtccagcccgggcgagctgctggccaggccccctgcttccgcgggcatctctgtccaggtcagacaagggtgcggcattggtctcaagcaggtcgggtgcagctgccgaggctgcacgtccttcaggtgcatttcccaagccgactgtcaagcgtcccgggaaagtagctggctggcagtgggcgcgttgggacagtgtcctgctgccatccacacatcttcattacgtgtcctgaaatcaacagtcaagactggactctggggtgactgcagcttctagtcgtgctaattgttcagatgagcggatgatccacaggccctccttttacatttcacatgttgtatgaattaccgtcacagggttttgttaaacattcagctaaaaacactctgtaattttagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattc

SEQ ID NO: 532 - DNA, 2694 bp, Homo sapiens
caaatgactatatcgatcagtggtgtaaccctgggaatcaagccttccattatgtctgccagagacttggagtcagtcacattatcactgagcccaaagaagaggctataaccacgaatgaggttataaaccaattattgcaccacgttggtgcgatgtgcatacaccaactcaatcttcttgccaccaaccccaatcttccaatcacaagtgtcttgggcaagcagcatccaattgaagcacatcatcttagcagtatttgtgacattatggagaaggccatggttaatggagatacctgtattatacgctgcattctcgttgtctttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacctggcggaacagctccaaaacaaccgatttggcagtgatgaggatgatcattacagactaaatgatgaacttttacactacattctgaagattgttgtacgagaatcctgtatcttaatcaccaagtgccaaactgtctctaaagatgattttcaaaagctcctttcaactgtgcctgctgcatcctcctgcctgcgctatctgatggcagttcagaatcaccttctcagtaacactattttgattaaacctgatgagaatgatgacagtgacagctccttgcagggagagacattgaaggtacaggagctaaaagtcagtattttggctcttgccacccaaatcctgactggatgtgatgaagtgttggaaatgctacagcaggtcacaactgccctcataaatagtgacatagcagaccgtgagcagaggttaaaaggcttggaacaagttactaaggctactatgcttggtcaccttcttccagtgttactgacctccttgatgcatccaaatttacagactctgatcatggcggatgccctgatgcctcagctagtgcagctggtactctataccagccagacggcgttgctgcttaaaacccagtgtccggtttttgctgaggtgggctgttccccgtgtggtgcaccagaccagaagtgcaggctgttccctgatgagagaatgttagaagagaaggaagagccaggatttctcactggtttaaagattcctgccccatgggctgctggaaagactgtggaaacagtccaccccgtcagagacaactataaatttaaagaaacggtccatatcccaggagctcgctgcctgtaccttagatttgatagcagatgctcttcgcaatatgactatgacaaattggtgatatgtgcggggcctaacacaaacagtaggaaggttgctgaatatggaggcaacacactgggatatggcagccgtagtgtcttaggaactggttggccgaaagacttggtgaaggtggaaggagatacagtcaccttctcctttgaaatgagaagtggccgtgaacacaacactcctgataaagccatgtggggctttgcttgcacagttcgcgctcaggagtcttcggaggatgtctcaggaggcttgccctttctggtagacctggctttaggtctgtctgtgttagcttgttccatgttaagaatcctgtacaatggaccagaaattaccaaagaagaagaagcctgtcaggagctattgcggtccaaacttttacaaaggtgccagtggcaggtggaggccaatggcgtgatctcccctgcccttactccgagcccctctccactgcctctgaccatagaggaagacagagaattcacctacccctctgatgtcctcgtgcctcctgttggaaactactttgatctgcctcggatcagactgcctccaggaatcatgataaagctcagggaaatttctgggcgtgctagacctcaatttagaccaagtataaagtatgttgctgtgtagtgttttacttttcccaatgggaaaaaaaagtttaaacaattgaaatgggtatatttcttctgtggtctagtaaatgaaactttaattttatgtttactccatgaatgttaaaattaactgagtctagagggcccaccaggcagtattccagactaggggctctcaaaatttggcccaccagtcagcagcattggcatcacttgggaacttgttggttcttggaccccattttgcacctattgaatcagaaggtctgaggatggggcgcagcttaacaagtttcccatttgactgatgcatgctaaagtgtgacaagtgctaggtttatctctagtattttgaccttctactagcagtcagcctctactttactttccagagtctagagacatgtgtttatttttgatgcctagagaaatggtgaggagttctctaatgtagaatgtacatacagttacaaatgtctgtggtattcttgcttaaagtcaagtctgttttgcaggcctctgctctgcctcctgaggcaggttttcagagagaaaactttagagaatatatgaaatttaaaatg

SEQ ID NO: 533 - DNA, 3345 bp, Homo sapiens
gttagtctgtggtcagttacgtggtgaaaacacggctgtgccgcggccgcatctttccgcggccgaggcctctctgggtgggagtgttggcttcctttccggatcgctaaatggggaaagttctggccgctcggcgggatacgtctccaggccacggatggttcgttctccgtgccgcggccccgagctgggctccctgggtctccagcgcgggctcccggcattgggggctgcgggccggcccctccgccccgcccccgccccgccgcgcctcctcggccgagcggctcgcggtctccggcgcgggaggctccgagtctgcccactccgggccgagcgaggtctctggaggagaagagtggcgaggaggtgagggcacgccggcccccgcccggcgggtggcgccaggacttcaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagacacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgc

SEQ ID NO: 534 - DNA, 2517 bp, Homo sapiens
gaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtaaatgagtcggtgttggcggggccgggctacacgacgttggctggcctggatctcagccacaacctgctcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgagaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgaggaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcgacatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagtt

SEQ ID NO: 535 - DNA, 2483 bp, Homo sapiens
gagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcaggcccaagaccccataaaactgtttgagccgtcattgcaacctcctgtaatgcagcagcagcctct

SEQ ID NO: 536 - DNA, 3466 bp, Homo sapiens
atttagacacaagcgagaggatcatggcggatggccccaggtgtaagcgcagaaagcgggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagagctgctggaaggatgacataaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggggatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgactccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagagggggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaact

SEQ ID NO: 537 - DNA, 3302 bp, Homo sapiens
ttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagggccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattgcaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 538 - DNA, 3584 bp, Homo sapiens
atttatgagctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacggaacggcgacctcaagaagcagctccacgaaaggcagccgcggattgccgcgctcagcgacaaacaaatcgcgggcagaacctctcatctgtgcacaagggacccagcacggggctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagccctcaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtccccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttggaacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgaagcgtttttctcatggagtttctgggcagagtggagctgcaaccctgttgtggggggcagcatttggcaggttttctctttggggttgaatcattcaacttaacgactgaagccctttcttgactcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttccagtagtctctgcttcaaggtacaaatgggaacacctcccctcgggaagcctggccaagctggaagatccggcaggttttttaagagccgggtggagggttggggaggaaagaaagggcggtggcctcgggaggttccggccttcggggaccagacttgctgccaagggcttctgcatccagggtgggcagtggcagcttgtcaccctcgcccgattcccacatcccagtcctgagggactcagcaaaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttc

SEQ ID NO: 539 - DNA, 4053 bp, Homo sapiens
ataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaacgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccgagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatatcatttgcaaaataccttgaacttaggttttatgggcaccagtatactcgtagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcatcgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacaggcaaggaggggaccgagaatcaaggcgttgagcctcaagatgaagtagatggaggagatacgcaaaagaagcaactcataaatcctcatgtggaacttcaattttcagatgctaatgccaagttttactgtcggctctactatgcgggagagtttcataagatgcgtgaagtgattctggacagcagtgaggaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattcttcgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttg

SEQ ID NO: 540 - DNA, 2363 bp, Homo sapiens
agcgcttagagaaaatgcgagaaaatcaggcccttccgtccggcgcacagggccagcacccagcattcgggcaaggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacaggcacagtgcctcgagtcccctactttgcgatgcccgtgagggagccggaacggtaccccctccccaccgtcctgtgagtgcctgccctcccttcatctacgcagtcaagaaacgcacccatggggcacctgctctcggccaggcatgcacagcacacagactgagaaatgagttgaggatcttgccctaaaacgtgcagtgcagagagtgatggttacagagcaagggggtcagggcattggcagcctcaggggggatggtggtagcctgaatgggcgaatcaggaagagtgctttcccggccagatgcactgggagtttgggagaagctccgtaagcttagtgggcctgaatctgcggactgatgccccgcctgcaaaggcagcctggcagctacactagtcctaacgtgggcgccgatgcagagcgcagtaaggagctgctgccctctggtggatacagagggcactacaccgagcaggaatctcccccggtcccgttcacatttggaaaatgttctcctaaggactttctgtccatctaactaaataggaaagttccttgcctcctgcccctctctgcttttatctaggagagctcctttctccagggaaggcccactctgccctgaaagatgacttgggtactgtggtttctgtgcactctccttcctgaagcgcaggcagggggatcattggctcacacgaggtgtcctggagtggggtagggtggtgggtggtgcctggcctgggaggtcagtggatagagcttgggatttagctccatgccaaccactcccggcttgcctcagagtcctaagattcaccatcatccttactgataaaacagcatctgttttcataagtttaatggtttttaaagaaacaggcttcactgcatctaaaagttcctttttgcaagtcagacaggatcattttacaaaaaagggaacgtgaggctcattgatcgcctggggaacttgtgctgcgtggcctggatggttggaggcagagcttggaaaggaagcagcatctcccatcaccacctctaggactcgggggctctctctaatcttggaatggctctgagccagtccatccctagagtatagtgggactctcctggggacaggtatcctcttgagatggctctggccaggatctaccccccatccccatcactgtggggagagcgggacatctcaactctgttccttcttcaggttgcctggccacttgcactgctgctgacagtttcacaacgaacgcaaagggccaaccaggtggttgggagaagagggtcagtgacaggcctggggcaagcccctccctcccggaatcccctccatcagcaccatcaccatttcttagaacatttgttgtgtgtttactccttgtccagagcttcacatgcattactgcatttattcctcaagtcaaagctaagagggggataccaccactgggccattcttaaatatgcacacttctagcaggagttaggaccagagtccgtcccaggtctgtctgacatctgtgtcctcactcttaaccactgtgccattatgtaaatacaggttattcccaccccaagtccagggggacttatcaggtgttaaactgacgagtagccggcaggtcagcttgagctggaaagtgggcacgtggggctgtgggtgggcacgcaccaccttccttccctggcacactgcataacaccagtcccatcctcacccctaggcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaccatg

SEQ ID NO: 541 - DNA, 2486 bp, Homo sapiens
attttttgtcaaatctttgagttggagccaggcacagtggctcacacttataattccagctactcaggaggctgaggcaggaggctcaattgaggccaggagtttgaggccagcctgggcaaaatagcaagactctgtctctctagagaaaaaaattaaatatctctctaggaaaaaaaaggttttagtgcctaccgtgtaccagacactaccctggagatacatcactgagcaaaacagatgagtatctgccctcatggagcttctgttctttctagtggggagagacaaacaagaccctatatacaaacatatatatgtgtgtgtgtagtctgtcatatatggaaaagtgctttggagaaaaataaacggaaaaggtagaatagggaatgcttgtgggcagggagctattattggatatgcgatgcttaaggaggcctcgccaaaagatggaatttgagcagagaccgggaggtggtaaggaaatagcctcactggagactgataaaacattccaagcagagggaacagcaagtgcaaaatccctgaggaacatgcgtggcaagcttgataaacagaggggattatggtggtgtgaacagtatgaataaaaggagatgaggtcagagaaaaagcagtgagagggagcagatcgggtagggccttgctggtctatctagactttggcctttatcagagatgggaagcagctggagaattctactcaagaggagaatctgattgacattttgaaaatatcactggctgatatatttaaactacactatactacagggacataagggcagacaggaggaaactcatttgaggaaatgtacaataatctaggcaagagacagcaggggtgaactggggggcagcagtgaaagtggttggattctcaatcaatctaaagttggatccaacaagttttgataacttggatgtgatttgtgacaaacagcagtcaaaaatgagccaccacacccggccccatccttatctttggcacttaagattcttcttccctgatgtacctcaaaggctcttttttctccagctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaaggtgaggagtctgaaagaaggtccccacatatacacatctctcctttgcttggccacattccctaagataatttagggcccgcttgcttctttagagctatattgtggtctgtgcctagaagactaaacttctagattcttgtcccacttcttcctttcatgggcgtatcttgcttattctgagcgtgaagggctctttcacccgtttgtaggctgatgtctcagcctcaccacagattggaattgatttctcaagctatatatctaagtccaatttctcccctaagcctttccattttttacagatgtgaagccaaactacttgaagggtctttctcatgtacttaacaggctgcccaagcctgtactcttgccagagctgcccacggtaagtcccacaggcagagcttctaagcaaaggacaaagctattcttccccagatggggctagaaaggggagggaacaagaaccaggatcttcatgatgtggccatcccctaccttgcccattgccccttagcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 542 - DNA, 2815 bp, Homo sapiens
gtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggttatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacctggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtggaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccgg

SEQ ID NO: 543 - DNA, 3303 bp, Homo sapiens
gcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccccccaggacccgttcgccttgtcatcggccggcaccctaatccaaaggtttccgagcaggaaatggatgaagtcatagcacgcagcacttatcaggagagcaaagaggccaattcctctcctggcttaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccaaaaccctctcctccgccagaggaaggtaggctgctacgatgccaacgatgccagtgatgaggaagagtttgacagagaaggggactgcatttcactcccaggggccctcctgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacaaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgaactggacagctcctcagacctcatctcttccccagggaagaagggggccgctcatcctgaccccagcaagacctctgtagacacagggcaagtcagtcggccagagaatcccagccagcctgcatcgcccagggtcaccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccggggggcagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagcc

SEQ ID NO: 544 - DNA, 3093 bp, Homo sapiens
attcagacctggaaagtcaaatggcactcccagacgctgcttatcagcagtgtgcacaggctgttaaatgcacctgggccgcaattcctgaagagggagtcccagtacaatcctttttacatatgcaagggtcacaggaaccctatgtgcaatttcttacaagatcacaagaggcagtgaagcgtcagattcctcataccacggctgcagaaatgctaaccttaactctagcttttgaggatgcaaacgcggattgtaaacatgcactggcactggtgaggtgtataaaaaacttgggaagttttctcagagcttgtcaagatgtaggaactgagcttcatcactttgcaatattagcgcaagcagtggctaatttagcagttgacaaatctaaaaggagccaagggtcaaaccctaaagtgggaaaatgttataattgtgaaaaacctggacattttaaaaaggaatgccgccagatctcagtacagaaaggaccttacaatgcagtgccccacccagtggaaaaaatgccaggactttgtccttgcgtaacagaggaaataactgggctaatcagtgccgctcaaaatttcatcagaatggcacccccctgctgggaaatgagatgggggcctggacccaggccccacaaacaatgagggcattcccagtccagacctcaaccccgttccaggcatgggttcccagaggcacattgattccctcaccccaggaacacaaggagtgcaggattagatctcccagtcaaagaatgggtaatgttagttggggcagacaaacccatcaaagttcccactgatatttggggacctttatcagcaggatatgtgaaactaattttaggcaaaatctgccttaacttacagggcattactgtagtcccagaagttgttgactctgattatgaaggagaaattcaagtagttttaatgtcacaagatctttgggttttgagctgggacaatatactgctcaattattgcttattccctgcaaatcacacccttctccatgaaaggagaaatgagaaaataaagaggttgggagcacaactacatgagaaatctatctatcccaacccatagcctctaatagacctacctgtgtagtacacattaaaggaaagaaattttatgggcttatggatatgggagctgatgtgtcagtcatatctaaagacagttggcccccatcctggcccttgcaattaacttctacatccctagtgggagtaggaacagctcaaagtgttcaacagagcactgagattttaccttgtcttggtccagatggacagtcatgtacttttcagtcttatgttgaaaatatagctatcaatttatggggttgagacttacttataacatggaatatgagacttacaaatgaaaactttgataacccaggatttaaaatgttgaagaacatgagatatcagaggggaaaatgtttaggaaaatttcttcaaggaaatcctaacccaatatcagtaactggaaaaacagatagaaaagggctaggacgtcaggatttctgacgagggtcattgatatttctcctctgcccactgcctcactattagaatggctcagtgacaaacccgtgtgggtggatcaatggtccctatctcaggagaacctgatgcaacttcagcagctagtaaaagaacaatgggatgccggacacataagcctggaattctccagtatttgtttttccaaaaaagtccggaagatggcgactactacatgatttaagagctattcatgtacacataaaactgatgggtgccttacaaaaactttcaccatctccagcggctattccaagagactggcctcttgtagtaatagatcttaaggattgtttctttactacacccttacacgagaaggataagccttgatttgcattctctgtgccttctattaatcaaagagaacctgtttctcattatcaatggagagttttaccccaaggcatgcttaacagtcttacgctatgtcagcattttgtaggacaggcattaaagaagcctcggaatatgtttcctactgcttacatcattcattatatggatgatattcttttggctgctcctacagatcaaaacctacatcagttattcagagaaacaaagcaggctttgactaaatggaatctcaaaatagctctagaaaaggtacaaacaacttccccataccaatacttaggaactattgttacagagagaagtgtatggactcagaaagtagttctccataaagacaggttatagactttaaatgattttcagcagttattaggagatattaattggccattaccgatgttaggtattgctacctatcaacttacacatatttaccaaaccctgcacggagattctttaaattccctgcagcaactaactaaagaggcagaagccaaattacagcttgtagagcaaatgttacagcagagacatgcctcatggctacaaccacaaaaacctttgcttttgtttattcttcctaccccctactctccaacaggacttttgggccagtttatagactagtctgtaacagtaatagaatggttctttctatctaatcaaacagtcaaaaccttgcaagtttatctttctttaattacacaaattgtgactatgggcaggcataggtcacaaatgcttacaggatatgatcctgacaaaattattgttcctttagactctcagcaacaagctgcagcttgggaaatgtcgactgcctggcaaactgctttcgcagacttcatgggcgtgatagataaccactactctcagacaaaattttacagttttataaaatccattctttcattcttcctgtgattactcatcacaaacctattccaggtggacagacttattttactgatggctcttccaaaggtcatgctgccatctatggactaaaacatactcaaacaataaggatctctggggtttcaggtcaatgctcagagctagttgcagtcagctgtgaggttttacagctcacagcttcagatcctatcaactgcccccggaccccttcttccaaatat

SEQ ID NO: 545 - DNA, 3310 bp, Homo sapiens
atcttgggcctgtcacttggggagcactgtagaaggttctggagaaggcattgagactataattctactttaatgagctgggctacctagattctatggtacagcaagagaagctgtttgtatgcacctgtatgtacgtgccttacttaaaattcagaaagaaaatcttcaggtgccagaattacttgtgaggctggtgaagagtgaaaagccacttcccaggccagacaggaaagagtgccctggttgggaccagacgggcctggctgcagacgtacactttgggcttcagcagccctggtgctgccttgagcttgacccgaattgcttcttcccagaggctgggtctccctcgcagcccctgctctcaaggatgggaatgagaaggtcgatgacaaggcacctctgctttacatccaagcgttgacttttgtggcttcctttaccccattgctctgccctttaaagggtcctggtgtgtgtgggaatgggacagacaattttgtttttcacaatggtattgggctgtggatccagaactcaagttccagaggaaagcgatgccaaagtcaacagggatgcttcacggaggcagggaaaatgcaggagtcaagttcagcagctgtgtggggaccaaggggacacaatatgagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagatcccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatttatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttt

SEQ ID NO: 546 - DNA, 3088 bp, Homo sapiens
tatcattttggaggaaaagataatccaacgcaaaagcaaggggtgacattgaaaagcaaggaagcttgagtaaaaacaggaatgttgtttgactcatcatctgtgtacgattctatcctagcctcctgacccattgtctcttcttgtccaggggttgctgtggcactgaagcaagctatgactctggaatttaaagtttatcaacaccaggtggtggccaactgcagggctctgtctgaggccctgacggagctgggctacaaaatagtcacaggtagagacacagatggtgttcagcaggcctgttcttgtggttgtattaaggcttgcttctcagtttgtgcaaccaggatgtggcccaggctctgctgctgcagctgcaatgatgggcccaccttgggaggaggtcagccttgcctccaactggaaagcctccccctgcctcagaccagccagccgcccccttgggtgagccacagatgatgggaatagtggttgccattggtcaccagcataaggactgcttgtcctcagaacagctttgcaggaggatgacctgaggctcaactgagaggttgggctgtagtggtcacacacctggtaggtggcaccaggactgtgtggtgatgccttgcactgtgccaggggagtgtcttctctcaccccgctgagctgggggtgcaggggctctcccctcccagtttcctgcatattcctggggagttggcttgctttaggcatgtttgcttggatctgtacattctggagctgatgggctgtgaatgagatggacttcccaggtcagggccccactctggggtgccatccacctcacagtcactgcagctttccacggagaacgcatttttttggcaggcagcatactcagtcctccggaggaagggcgactttatacctagtcccacaagactgccgattgtgctagcagtggtgtggtccaggaatatgggtcctgctgtgtgtagacctgagtgcccactctctgcaccgtgtcctttgccctttacagggattacaggccctctgatctaaggattggggagggattacaggcctcctggtctaaggagtggggctcccacccaatcctgcatgtgcggcagtgcctgggaaggccgggccagtgctgtctcctcagcagtaccagccgtaccctcttttatgttctacttcacttactttctgttctcccttcatcctccatgtcttcaaataataaagctcaagaagtcctcgtgcagactgtgaacttcagggtgctttagctcaggagtccccaacctccgggccacggactagtactggtttgtggtctgttaggaacctggccgcacagcaggaagtgagctgggccgagagcattgccacctgagctccgcctcctgtcagatcagtggcagcattagattctcagaggagctgaacgctggtttgaactgcacatgtgagggatctaggttgggcctagacactttcaagaaactatcttttttttccttctgattatacctgcatccttatgagaatctaatgcccgatgatctgaggtggaagtttcatcccaaaaccatcccccgatgccatccgtgaaaaaactgtcttccacataaccagttcctggtgccaaaaaggttggggaccactgctttaggtccctgtttcttaaacttcaatgtgcacaccacccctggggctgttggtgcaatgcagattctgaccaggccttgggtgatgctggtctgggagccacccttggagttgtgagggtttaggccatagtccctgtcaccatgggcatctcatggcatgggcctgccctctccctggtgactgtgtcattgtcactctgccatctgaggacccgatgcacatggctgagacagataatgcttgcaaatgccctctttggtgcctggtgctatgagaagcactatgtccagtatcttacttaaacttcatgacagccctgtggattattggtctttttgttacaaatgggcatctgaggtttcacaatgttgagctgcctgcctaaagccacacggcaagtgggtgggcacagctggggggctgcaaagccaagctggagccctagctcacccgcatcttgaaagggatccccgcaacacagctcagaagcagaggccccagtgctgtcagcacccaaggcactaccccagcttaatgaaggttcaaagtggaaggatcctcctgtatgacctcgggccaggtccagaaaactctgttagccttgctgttgtcaccttaccactttgataataccatcagcctcacaggatccgggaaaaacctaccacaggctacagtgtctggcacctaatgtgctctgtgaacatgccccttaccccccaaagtaaattgaactgctgcccaatattcatgctgccttcaggggagcctttaccatcaatgttagggaattgcccaagcaacttgtcagagaaaacaagccaggagcagcctgaggaagctgtcccttccccatgggagtgtcaggccctctgctgtatgatcagttacccctttcaaaagtgctctgtccttcctttcacattcttaggcacgggcatctctcgtggggattagaatcccaggccatgtggtgggggtgctcaccttcctgacctcatctgctttgactgccttcatcctcgccttcgtttctcagagattccttcacggcatagaattcgcctgcatttctacatgtccaacatggtgaaaccccgtctctatgaaaaatacaaaaattaaccaggcctggtggcaggcgcctgtaatcccagctacctgggagcctgaggtgggaggatcccttgaccctggtgggtggaggttgcagtgagcggtgatccccgccactgcactccagcctgggtgacagagtgggaccctgtctcaaaaataaaaaagaaaaaaaagatgtataagctaagtgtgaaagcaaggctaatttctcagatttctgtggcttttcttgtgaagagagaaaattagactccagtcctgggattgaatgtctttattaaataaacgagtaaatggt

SEQ ID NO: 547 - DNA, 3791 bp, Homo sapiens
attgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacctatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaagcagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagggacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttcttttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgggccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcatagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtat

SEQ ID NO: 548 - DNA, 2301 bp, Homo sapiens
tatttacctgtaaacattgaaaaaactgaatcaaatgcagtgatatcggacctagttttattgttatgccttataatgaatttaacttcacagttttctaaatgagagcatttcccaaagacatctttatggtcataaccagtttcccttggcatttgatttatttttatttttatttatttatctttttgagaaggagtttcgctcttgttgcccaggctagagtgcaatggcgtgatctcgggtcactgcaacctctgcctcccgggttcgggcgattctcctgcctcagcctccaagtagctgggattacaggcatgcaccaccacgcccgactaatttgtatttttagagacggggtttctccgtgttggtcaggctggtctcaaacttccaacctcaggtgatccgcccgccgtggcctcccaaagtgttgggattacaggcgtgagccacagtgtctggcctgatttgtttttaagagcattatttttctgctttattttgtgacttcaacatttgacacaattttgggtgaatggtttgtgcatggtgcctgacatcgtgttttgatgtgtagtatatgccataggacatgtgagacaagatatgtcccaacttgaccttgttttgtactgtttatgtcaaggtgttgagtgtattagatatactgttggggctctgtgttctagctctgccttttagataataaccatggttaaatattgcaatgtcctgcatgtctccacacatgggttttgtaactgagtcagaatgataagtgattagtaagcacattttttctcctttcaggaaaccactattttccttttctacatgctgttttgtaagtagtacttttatgaaggttgtcttcaaatgttcgcatcttccatttctactgcccttgggttatccatcctgtcattttgtgccaatcacttttttttttaacttttaagttcagggatgaaagtgtagatttgttacataggtaaacttgtgtcatggggttgttgtacagattatttcatcacccaggtgttaagcctagtatgcactagttgtttttcctgatcctctccctgctcccaccctccaccctctgataggccccagtgtgtgttgttcccctctgtgtgtccatgtgttctcatcatttagctcccacttacaagtgagaatgtggtgtttggttttctgttcctgcattagtttgctaaggataatggcctcgagctccatccaagtccctgtaaaggacatgatcttgtacttttttatggctgcatagtattctgtggtgtatatgtaccacattttctttatccagtctatcattaggcatttaggttgattccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaccaaatagcttaccctctttaaatttcccttttacttcttacaaactcctaacaccatttacgactttgtcatcaatatggtcaactaagcttggtttgcatggctctacttcctttcaccttccacttaggcagtgtctccaagtccactgcagtttctatttgtctcctgactgttactgtatcagttcttacctaaataacataacaactgatctccctactttttgcctatgccctcaaatgtgctcattgttgatctatctccctgttaggtgttctttttctcctctttagaagcagccaaggaaaccagggttctctcaaagtggaaaatactggaacttatgtactgttatcataatgatagttggtgttttgaattataagaatgattccaggtggtttctaaatcatccaataaagctgtattcactctgt

SEQ ID NO: 549 - DNA, 3218 bp, Homo sapiens
actgatcatggacactctggagaagaaagacttcctgaaggtaggcgactgtacctctcttgtcctggaatgggcgatggctgggagaagtgaccaggccccaactctctctccagcctcgcctgattctctaagacttgccagcccttctcctgacccctgcaccgcctcctccaccttcgttcattcagcaagaatgaactgggctggggtgaaggaactctgcaggggcaggaggagaggacaaaggaaggaaaccaacttcatcagtgttactccagtggcttctgacacacagaaggggactgtcatagtcatgcttgatctcatgctcattcttttaccccctagtgcctccatactgagaggtacacacgggtgaacacgcacacacagacatgaacaggacacgaaagcaaagcacaggaacaagctctggctcattcacagaatcatttattcacaaatgtattgagtgccatgcaccaggcatgtttttagggctgaggagatggcactgaacacaatggttatggcccctgtcctcatgaagtttatagtctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtctttaatgccgcaaaggatgaggagagagccaaataacgcagagaagagtgtttggggtacagaaaacagtcagtgcaagggcactgcagtaggaggggcttgcacatttgaggaacaggttggtggtccctgtggccagagcaaattgagaagagtgccgaggaagagatgtgcttggaaagggtcagattcatgccactgggatgggaagaggtaagtggaggttcacaggaggtttcctgaagaaatcagctcctggaggaagtgagggaagaaaaaaaagggccagggagtgccatggcaaccaattctgagaggtgagaggtcatgggatgccggggagggtgatcagcagacaggcctggctggagtggaagggcgtgatctggaggtcccagccctgtcattgccttgggagaaagaaaacggccacaggtctaagggctccaaggcaaggctgatgggatagagctatggtgggtgaaatggggtgacagtgaggcaggggacacaagccgttccattgtctttctgtctctccacagcgccgcccctggctgggggcacccctgcaggtgggactggtgggcttctgcctggtatttgcaacccccctgtgctgtgccctattcccccagaagaggtaagtgctgtccctgggctgggtgggggactctggattggactctgcatctctggaccagctgacctagggtcttccagggtgttcaggaggaggcctggcaggcactccactgattctgggagtgggggaatgacagtgagccagtccttctggcagtagaaggagaggatttttcagcctgggaggaggtgggatggcaatccctgggcctgagtggggttggattcaggggacgttaactggcctgtgctgttctattgcagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttaatggagtttcactattttgcccaggcggaggttgcagtgagccaagatcctgccactgcattccagcctgggcaactgggtgtctccagtgggagacactgtctcaaatttaaaagaaaaaaaaaaaaaagaaggtataaatcagtatgccagatcttactgtgattactggatgtaagtgaccttctaaccttaaggctgcgaatataagattagattctgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatc

SEQ ID NO: 550 - DNA, 2829 bp, Homo sapiens
atatgtccaagacatgttctgaatctcctcaaataagcattgaccttccttggaacttgcttcttttctttttttcttttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcacccccagagattctgatttacttggtctgggatgaggccctaggcatgagatcttcaatgcccctaggagaaaattttcatgggcagtcctaacaacctgtgcgataacctggcccaaaaacaaatcatgatttgcaatttgaaaaacatagacaatgtgtagtaatagacactaatttccaaaaacaataacatttacaagaagactagtttattcactgaacaaacaatgtgccaaggaccatcctggacactaaggatataaatatgctgaatataatttctctacccttgaagaactggtaccctccttttcaaaaatgaaacacacccacatgccagttcccagatgaagggacaacaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctattttttggatggcatgtaggggtttcacagtttggggctaggagcattctagtacacaggtctggtgaatatgtacacatttggtcaagtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggccttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatg

SEQ ID NO: 551 - DNA, 3004 bp, Homo sapiens
gtacccggtccgggtcggctgggctgcccgccgctccgcgcgcccgggcggtcgcaggtcgcgcctgctttggccccggcgggttcggcatccgagcctggcaggggccaatagaaagtttcctacactactgaggtttaggggcactgtgaagcaaaagccacgcctcagaatcccaggcggagactccgacctcgtcccgggagggaagccagtagctgagcacctgcgggagattaaagagaggaataaggaggtgagtacatgacaaagagccacagtcgcaggcggtggggcctggctcagaacaggctgtgctgggaagcgggagcaggagctggcgccgccttgcgggctggcagaggaccatccactccctggcgctggggccgtcccatctcatgggcaagaaacgtgagacccctggctcgctccacacacaacctaagtgccagatggatgagacgcctacgcgtgagtaaatgccaggaacatgagactcgaacgtggcaggatatccttctgcccacgaatctaaaagcttactcggtaatgggagaatggttccaatttgataaactcgggtttttggaacgtctgtgctccagaaacactggaaggcaagtggctgctgactggaggagataattggatgctgcaagcggcaaagggctcgggatgcaaaacaccgcaagaaatgcaacaagtgaggagcattcccgcaaagaaaaaacgcacaggccgtgagccaccgcgcccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtacttaatcttccaacaataaataccataagtgcatgtctgttttattttatttatttatctttttgagacagagtcttgctctgtcgcccgggctggaatgcaatggcacaatctcagctcaccgcaacctccactcgcaggttcaagtgatcctcatgtctcagcctccctagtagctgggatgacaagcacacgccaacatgcctggctcatttttgtatttttagtagagacggggtttcaccatgtcggccaggctgatctccaactactggcctcgagtgatctgcccaccttggcctcccaaagtgctgggattgcaggtgtgagccagtgcacccggccgtatgtcttagagtgaggggaaactgaggcacaaagcgtttatgtagtttgcccaaggttacacatggtaagcagaaaaactgggatttgagggcaggcagcccggccccagagttcccttagccccctgaactgtgctaccttccaggtctacctgtttgcaggtagggagacccacaaactatcataactgcacaccgtgaagcaaacacctttgttgcagtaacccgtggcacacttcacttcccacattctccaggaggaagccgtattctggtagtttaaggaaggtgattcatggatgccccaaggaaaggctagacatcgatgaattagctcttggattgtctaagatcaacctgaaggccctacctaaaccaaactcatatgatcccgatgaaagaggagaatacacagtgggagcagagctctttgtgtaagtttgttctattctgtttatttggaaactgcctctccccctagttctgaaagagacttgctgtgtgatagagaacaggccatttgtgcctgaaatgttctaacctgcaaattgggtttaatggtaattatcctgcctttctgtctgggaggaaacagagatgctacatagatgaaagctctgattatcatttaaaacaaataaatgtactaaatgccatggtataatatagggaagaatggatgacttcaaagagaccatggttccgttggaggcataaaattgcctgcaaagaggcaaatataatttccagaccaattaatgacttgctgccctcgtaaatggatttaggacatctttgttccttgcttcttttgttaaaactcattcttagtttcattatcagctcactaataataccagtgttgttaagatgctcaaactagagcagaattgtatgctggatgtgacgctaggacctcagatcctttgatagtgcagttatgaccaggatctctttattctgtgcttcacgtcaacatcattaacccgatgaagcgaagcacaagtcataaaggcacatcagagaagccaagaaagcggggccgtacagagagcatcaaaatcaggtcagaaaaatgctgctttcctcttccaccaaaccttctccctgttgtttttacatgccccgtccctccagattcagcctccgttttgttctctctccttttccttttcctcctctcttccttactttcccctgtgagatgcttttctgtccttttactgcacctcttccagacctatggcatttggggacgggtcacccttcctagagtgatcctgaatccagctgcctcttctttttttgtttttgtttttgtttttgagacagagtctctttctgtcacccaggctggagtgcaatggcgtgacctcagctcactgcgacctccacctcctgaggcaggagaatcgcttgaacctgggagacagaggttgcagtgagccaagatcgtgtcactgcactccagcctgggcaacagagtgagactctgtc

SEQ ID NO: 552 - DNA, 3530 bp, Homo sapiens
aagtgcggtccgcggagcgtctctggcgcttaccctgctttgggcctgcgtcgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttc

SEQ ID NO: 553 - DNA, 2553 bp, Homo sapiens
aatgaaaacccctgcggctccgacgcagatgcccacgttgcccaggccttcacagacccccaagccggaaccgccgggaaaacgattgccaaccggccacaacacccaggcagagacgcagggagaggctgaccagaagaaaggccgacgtgcaagaaacccagcctccggcgcacagggaacatgtgtcccaaggcgcacgcacacacagacggacagagacagaaagagagggcgacggaaagagcgagaagggagagagggagagagagagagagagagacttaagagagagacggtagtgggcacacagacacgcacgcacgcgcgcgcgcgcacacacacgcagacacacagacacacacacacacacacccccataatggacacagacatacagcaggtaacacccacccccaggcagcccctgaagctgccgggttctggtctccgcgactacgagccaccggtgagacagcagcccacgggcacacagggagacctgtcctcgacatcacaagggcgccacttttggggagactcacccgcacaccgtccgcgcacgcctgaggttgggatcccgcgctgcctccccggcgatctgtctgaggtttcttcctcctggggtttcttcctgctggtggaccctccgcgaatcccggcctccggagaccgtcctggtaactgccctggccagggctggtctcagccccgactctgacgcacgaacacacagggctcctacttcgccaagtctcagggacccatcccccggcaacggtggcggtcactgtgaccaaagcggcggctcgggcttcgcgcatgcgcactggcgaggccgactcacccgccccacccccccttactcggcagagtcaggctgcggaccctttaaaaaatggcggcgacgcggcggctgcggggactggggcggcggtgctggaggttgcggcggcggctgcggcgcagccccgggcggcgggtgggaagaggactaccagaggggcctgcgggagacccagggtcggacccataggagtcctgtcgtcaggacctccttgatcggtcttctgcttgggttctcggtgaaggaggagcttcggggtgtcggctgggctgcgcggactcctcttgggatccgatgatggatcccacccggtgatcgggaatggggttacaatgcagtgaggcggaaaggctctcgccggggcacagaaagatccccagggccgcaaggcgtgctgtcgcctgcaaaggcactgacccacgagcccactgcctccctccttcctgggtggagcaggggcctgccttcatctccaaggcccgggggctccggcatctcgacgcggcttccggcgacacgggcaaagagagacagaggctagtccgagccggagccagtgtgaccacacgtggcactgacgtcccccaagagcacatgcagtgagcctgtgtctctgaggccgtagtgggcgacgatgagacggacagtgatgtccaggcctgcgcccgggggccactggagacctgcccctcaaagcggaggaaacgccaagcgcacctgaaaacctgcgagacagggcctgtgcacgagtccagtactcctacttcgccaagtctcagggacccatcccccagcaacggtggcggcgcagagaagagcacggcgccggcgcaggtgcagagagacaggaggctgatggggggaagttgaggcacctggggcagagaaaaaaatgcatcgccaagcggtttctgggtcatctactgacgaaaatgtcttcccatcagcccttgcgctggtccccagggaccctggcatccgtcgttggcgcccagggtgcgcgtcgggccactaggggtaccccaactcggacagaaggcccatgagttgaatttgaagtttgtgggaatagaggtgaggcaccaggggcagaaaaaaaacaggagacctcgcctcagacaagcggggcctgggtcccccatggatgaaagtgccttcccattatgctgtaccctgggcagagtggacagtgacgaccctggttcgagcccagggtgagcttcgggaccgcttgcggttaccagaaagcgaacaaatggtccatgagcggaaggtgaggcacctgaggcagagaaagtaaagaaacgcgccgccgagaagcagtgcctgggtccctcacggaggaaattgtcttctccttagcccgttcgcttggcactgaggtccctggcgtccctggtttgatcccagggtacgcctcgggccactagtgttaccccaaggtgggcagaaagcccataaggggaaggcgaggcacctggggcagagaaaaaaaaacttcgctgcagagaagcgcggcctgattccccacggacgaaagtgtcttcccatcagtccctgcactgggacccggggaccctggtgtccctggttcgagctcagggtgtgcctcagccgctacgtgcaccccaaggggagctttgggagcacaaagcccatgagggaaggtgagttttgagggaggagtggtgaggcacctgtcacag

SEQ ID NO: 554 - DNA, 3203 bp, Homo sapiens
acaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcagaagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtgtatccttttcaaaggaaattgtttgggcttcatcaagcctccttctttcctccttctcctcctcctcctcctgtccccatctcctccatcttgcttaccttccatgcccaaaccccagtcctttatcctccagcccagtcgagtcttcctgtttgtccctgctgaataatgaactgctaattaaggtgaacctcctcctccagtaatttcctttctaaagaggactgttaatgccacatagacaggaaggcagtatctgagcagggtgctggcaggggaaattggttgaagtcataagtgagcagatagccaacaaagatcagggaaagaaggggtttggaggtgagaaaaagagtgaagtatcaggtgcaggggggaacttaagactatccaagtggagcccaaggtctgaatcttagcagatcaagaaatacaaagagtgctttgcctagaaataatcctaggaacctacctgtggcaacagtagtcttgggggcagccaagggaggaaaccaagccttcttctcagcttcagtctttagaagaagatacagccacaggcagcaagacaccttggattacaaaagcagggaccaaaatttggacatttgttcttggaccatgggctcctccaccaatgggttctatcccaaatagctatccattggctgagggatcttcatatgataggtaccagacagcctgagcctggaaaccagcattctatgtgaactccagtaaccattaaggaaagcctcaatgtgctgaaaaatgctggcatcgagacccctgaacaaatcaacctgtgttgcctgaacatgtatggacactacttttgctatggataccaaagttaggcttaggttggccaatcatcagtattttaattcttcctaaatacaaaaaagggtatcatttatctttattttatagtacagtatcaatttaataatgtcatcgctatgtacccagttagttcaaagctctggcattatgagatggttaaaccatctgtcttttgcctaaagcccacttaatttagtcagtcatacctcggtgtccagtacctatgattcaattctgtttaatctggacagtttccacttattcaatcctgaaagtaaaaccaggaccaaatgcatctcaaaagtaataggagcctttactccaatacataagccttaaaatcttaagggaagaaacacaaagataccccatatggatttctgtagtggttttttcagtgtgatacctttcccaaaaaactcattctttgtagcaattttccaagtctggccctagttttaaatatgatttatttttcaaatgttggaacagagccccttctgccatttgcaaatggaaatgttttctctctccacctttaaaagcccttagggattgttgtacatgtgtgcatatataatctaaaatgtagtcacctttaaatttgcttttcagggagtattattaatggcccattttagcatgagtcatattagtgagaaatgggcaaatatgagtcatattaacaaggatgggttatctgagtcttgctctgcagcagttctgccagtgtgcaagtttttcagcattgagattttgaaaatgaaaaagaacattagagagaatgtggacatttctgtgctggctcaatggcccctgaattctatacctctgtagaagatggggctgtattccagcccttttgaatgaaaggctgtttgagttttggttcaaaatcttcgttataatacaccactttattttaaagcatattgcaaaaatgaccccaattccaagaacataaaataatggaaactcctggttacattgaaatttaatactgaggagttatatacatggccttgacttgctacacctccaagctcctccatttgttagggagggaacttctacatcgttgctgttcacctgggtgtgtagcaggccagtcagaagatcatgtgatcttggcccagaaagtcacattgggagcagcgattgtagaaataaacaaatcagtaggatggatttcattatagttcattttgcccaaatccatagtatcagggaacatggaaatatatattcccaaaaataatcagttttgaaagagtcattcaaatgttcattcaataaatatttcttaggcatggcttaaggtgctgaggacactgaaatgaatgagacatagtcctacaggtaacacatggtctaggagaaacatgtaagtaccaaaagtcctgctacactagagtaagtccctggtgctgtgagaacacatagggttcactcaagtttggggacaaagggtcagactttctggaccaggagacgtatacaaatggatctgtaaatgcctagagtttgagaagttaagtttagtaggtatatattctatgaaaaataattggctccttatcagtacttttaaaagtcaag

SEQ ID NO: 555 - DNA, 3452 bp, Homo sapiens
gaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtaattgcaaggaccattccttcttccaccaaacccttgcaggagaggtactgaacttgaaagccctaggaatttcatggtttatgcagccccagcaaagggaagaggattgagtctagcccaagggagcttatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaacttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacagggagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaag

SEQ ID NO: 556 - DNA, 2185 bp, Homo sapiens
cttatggaagttttatatttatgctgggtcaacttctttttaaaatacctggccccaggcaaactggatattcctggaccagctttctgccaaatgatttcatggagttggggagaggagagcagggtgagtcagggtaccaccttccagacagcacatcctaactctcttcatttctgtgacagagtgtttctgcaaatagggtccttctgtattatttctgtcctacctccctgttttctgaaccagatcaagttcagggtggcttctgctgctctccctctttatcctatgtttcatgcttggtaaaaacagggacatctcttttgaagttcagagtgagaccctcccctttatacttggatattttcggatactttctgaaatttaccactttagggccctgtcatcattttctgagcttcttctttttattttttgttcatatggcttctgtccaatctccgcttcttttggtagttcttacacatatgctggaatctctggattatatccttcttccagctctgctgaaaatgagtttgaggattttctgcccacatacaattgtgaagtagcactgcaacaaaaatcttcattcagaagcaggagagacacccagcagtcactggtccacagcaatgagggacaggcattgagaggctcccccgccctcctggtgggggaaattccttcattcaaacttgtttatactctctaggaggaactccctgccttattgctctctgaagcccagctatgccttttgagaggttctttcctctgaggcacagttttgacaatcaacttcctataggcgcaaatttcagaggctaacgattggtttagcggcacaggtttttgcttttgttttaagatctagccttcaggacctatgttgtttctaggtgaaatccagaaagtcatatgcaacaagaacattttggatgaaggaaaattgccattgttatttagaaacactcttaatctaattatatgacatgctaggtttacacttgcaaatctgcaaatatattggtgttagctattaaaagtattcaagatgcccatgacaccagtgggtctggggcttagaagccttttctggcactctaggccaggttaggtcagcttaatccacagactcacagcgtccaacaagggaagctgggtggcctgacaccatttagtatacgggcaaaaagtgttagcaacctgaacaacaccagagggcgttgctgtagtggatccaagaagaccaatgtcaggtttcattgtgttcagcagattgttaacctgggaaaaagtgtcacgcattgtaggaggatctattgtacaccaattaaaattgagaaagtctgggccacttcaagaagtacattttggaaaatgctctctgatacccggtattggattcatgagacattagtgtgtatattgaaggaaactcctaattttcttgtttcatgacatggctaaatgaatgatctgtctgctgcattgaaaaacactatggctacattggaaggtgcattaatggtatttattgtgttagcttgttaggaatccaggaacttggtttattgaacaactatgtttattgatccacataatattatgtgactgaggaatggtggctccatctgcctaatgaagaacgtttgatatgcgatggtttttgcccttttttgtgtgtgtgcttacaccggaatctttgagtttgagcaaatggctcttagcccttggattctgttgcctggattccattcacttactcacccatgtcctcattgtcatatccccagtggttcccttccccatgctttgtccccaggcctcaggtgaacaatcaccttgtctagactaagaaatccagtgcttggccacaattattagttcaaagatggacatatgatctggattaggggcttttgccggagctttggaggaaatgacctctctttcttactaaaggtaagtctggaaagagacaggcctaaggcactgccagtcatttttttccccttgggttgttctgcctagaattcatcaaacactaaagaagcagagtgaagaaaaggagtggtgaatggggtcttgtttacatcatttgagctctggatggtgctacccaggaagtgttaagaaataaatgttaaacccccttctatttactggggtcaat

SEQ ID NO: 557 - DNA, 2632 bp, Homo sapiens
ttttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggagccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaacttttaacttgctaacttttagaatgtccacctttgtgcattttcgtagcattcttgtttcattattttagaaaggggtcttcccattactgggatgtcggggccctgtcagagaactattattaaggctctgtgagggaactgttgagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggtttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacgcttgccaagtgcctagaggggctagaggctctctgttggtgtgtgtgtatttcttgaaactgcagagtcatttttggcatgctggcaaatgctactccttgcttttaggatgaatagggatgcctctttggcgataatttgacgtgtcataataaatgcccaataccaaacctagtctttctccaggcccttcagacatcattcaggtaactgggtgtaaacacaggagttggctttgtgaaactgaggcaggatttcctgcctctaaactattggcagcaaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactccggcctgggcaacaagagcgagactttgtctcaaacagaaac

SEQ ID NO: 558 - DNA, 2284 bp, Homo sapiens
cagctcctcctctcaggcttcccaaacttggcctcactgctaatgactcctcacacccggatggtagccaatcttccaagtcactttcagatagcactgtgggtggctgacaacgggcactcctccctctttactgagagggacactgaggctcatggagatgacaagacttgccatctcctggcacagacctctttccctctgcctcaaagctcttccatctacccacctccccggggcattctaagtcaccctcacagccctctgatgccagtcctgctcctaggtcatggcagccccatcttacccgtctggtttttgagtttgaacaagctcctcccaagcttctgtacctgatgtatctcatgcttctcctctttcaatgtgtgaacctgcctaaagcagaggggaaagggccctgcagagaggggctgctgaacctctagagacagagtttgagaaaggcccaccccccttctgccagcttacgattgagaaaggtgcattcactcaacaaacatttactgagcacgtacaggccaggtacagttcttcatagcagagatataagacagcaaaggacagacaggagcccttggtcctgaggtttccattctaggagcctttaaatctctgagctaacagtgacctttgatactctctacctcctccagaaacacgagcctaaggaggagagatggcttgtccagactcaaaaagcaaattagggactgaggcagggcagaaatacgggcccctgaaaaccagtcaggctagtgctttcctgagaggtgacaaccccagggcatgtgtggcaaggactagagcaggggtgtctggagaagagagagtcagcaaagagggcagtgcagaagagccatgctgcatgttctgtgctctggggtccctccaggtgagacctgggtgcccagctccccatttgcccttggcatcaggggctcctagcccctttcttcagggccccaagaggaaactggagtccaggattcacaggctggaatcaggggaccccactggactcttaccagtgaattgatgttttcagtgagttgactgattattgtggagcttgaatccagggccactgctagttcttggtactggctctgaggtgcatgcagagaggaggagttggaggaagattgtggggaggggtagagagaataatcattagggctggtgggggtgtgtgggctgcctcagctggcagaggggcaacaagcccctgctgtgggaggaggttggagggctagcctgcagggtcactgcacctcggcccagggcctcttacctccagatcctccagggtagcagatgatgcacggccctccccgtagatacctgttgctgactgcaaacgatgagagtgcacatggagatgtcctgtcccccctcactgtctaagccctctgatttcctttcttccccatcaactggcaaaagcttcttttctgcctatcttggaccctttttcccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacaacaaccatttcctgggtgtcctgggtgtttgcagcaggccatgtactaaggattcacataaaagcaacaataacgaatctcatttacacttcacaaatggaagtcaaaaaataccacctctattatggagatgtgaaaagagagacccaaagacctcaaacaacttaccctaaatcataggctaatcaatccctaatcaatccttagcagacggagaggcaggattcaaacccagaattcttaaccagtacccaacagtccatctacaatcttaacaattaccctctactgccccttgggccccctgtccccaggaccctggccagccaagactcacatccccaggtgagtggtaaccaccagaagtggctgtgtcagggctactgccattgattttctttttcctgttagctccttctggaatgccagggctcttcctctgccaatattcttttaactgtgggaaagaagagtagtaacactcatgagaacaatcagcccctatagccacatcctcctttacagttttgacaaaatactcttatacaccatctggtttaatgccaccaacaactgtacaaggtgttgtcacaatcagttagtgactgagagggattgatatcatggatag

SEQ ID NO: 559 - DNA, 3438 bp, Homo sapiens
attttattatgttaagagaaattcgtgacatcccaggaactctaaatggtttatatctctggctgtgccaaagactttttgtaagaaaacaatttgcaaaggttcagcctattttgaatgtgattcttgcagcctgccgacatttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagaaaacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagaagatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatatttttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaac

SEQ ID NO: 560 - DNA, 2960 bp, Homo sapiens
atggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagagaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttcgaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttacttttttaaaagttcatttttcatttgcctccgctttcacctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcag

SEQ ID NO: 561 - DNA, 2626 bp, Homo sapiens
ctgattaccactgatgctgaggatcttttcacacgtttcacggccacttggatttcttctgaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatcttcgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacgagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccgttctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcat

SEQ ID NO: 562 - DNA, 3828 bp, Homo sapiens
aagacggaactgccacaagggcacgcgggcctcaccagctgcctcactctcggatgtcttcccaggtcacccttgacgccctcaggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcatggaacaggtggtaggagagccccagggagacgcccaggagctggctgaaagccactttgtacatgtaatgtattatatggggtctgggctccagccagagaacaatcttttatttctgttgtttccttattaaaatggtgtttttgg

SEQ ID NO: 563 - DNA, 3544 bp, Homo sapiens
attttggtttctcttcaagaattaacaaaccacttactcttgaattctcttctagttaacacaggcatcactacttccaattgatctcaggatgtgggatcctcatacacattttgaacaaaatcctctgtttcagcaaggaattcatatttgcatatggtgaagatggtttctgaagtgagatcagaagtagagcttctaatgacccccagaagcactgagtgaccaagtgacatacctgccaggcccattgtgtccatcgctctcagagcagctggggattgtgcttggctcccagagctatggtgcaaaaggcggggtcgctagggccactcagggaaagagaacccagaaacatggcatgctgacaaaaggtagtccctgcttatccagcttcactttctgctgatttagttacccatggtcaactgccatctgaaaataggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgaggatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccacacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacgccttacatagctcaagtgtttcaacaaaagacagccagaagacaatctgatgatgacaagttccgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcccctccttagaataaccatgaaaatacaaatttacttagcacatttctgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagctatgtctgagtttttaaagtaaatttataagaattagccaataaaattgcttctcggccttttggctaagatc

SEQ ID NO: 564 - DNA, 2797 bp, Homo sapiens
tgcgctgtttccgtgtggatcgggtctatcgggccgtgactgactatgtgactgtaacaatgggagagaagtatgtgcagcccccaatgatcagctttgaagctatttttgagcagagcactccacattcgcccattgtgtttatcctgagtcctggctccgaccctgccactgatcttatgaaattagcagagcgaagtggttttggaggaaatcgcctcaaattccttgcaatgggtcaaggtcaagaaaaggtggccctgcagctgctggagacggcggtggctcgggggcagtggctgatgctgcagaactgccacctcctggtcaagtggctgaaagatctggagaagtccctggagaggatcaccaagccccacccagacttccgcctgtggctcaccacggaccccaccaagggcttccccattgggattctgcagaagtccctaaaggttgtcaccgagccacccaatgggctgaaactcaacatgagggcaacttacttcaagatctctcacgaaatgctggaccagtgcccgcaccctgccttcaagccgctggtctacgtgctggcgttctttcatgctgtggtgcaggagagaaggaagtttgggaagattggctggaacgtgtactatgacttcaatgagtctgacttccaggtctgcatggaaattctgaacacgtacttaacgaaagccttccagcaacgggacccaaggatcccgtggggcagcctcaagtacctaattggagaggtaggggtgaccggggatccttccgcaggtgcctctggggctacagagctgtggcctcgtgcccctattttcctctgagccctcagaaccagcctcttctgcccctgtgttccccttgggtttctgtgacaattctctctgctctcacctggttgttctttgtcctaagtgagctctgttcacatggaggttccctgagctggatccatggctggggatccaggcaaggcatcctctagccccttgcctcagctgttgctgtatacagagctcacaggaagcatccccggtggtctgcacacggctcaggcagtgacatcaattccaaagacagaagcagctgctggcttcttcagctgtttgtttgatgtgtttgggggactttgcctgctgcacaggagctcccaacacttcctgagggcttcttactgctttgggccctatcccttgggaagccagcaaagccacagatcaattgtgtgaacagtggcccgaaaggttatgcaagtcaacaggttcaagccttgcagcagccaggctgctggagtctcttgaccctgggtgagcctctggccccgggcccccagggtgcacacagtaggttctgagctcctggctggctctcaggccctctaatttcaggtcatgtatggaggacgggccatcgacagctttgatcgccgcatcctgaccatctacatggatgagtacctgggggacttcatttttgatactttccagccattccacttcttccggaacaaggaagtggactacaaaatccctgttggtgatgaaaaggagaaatttgttgaagccatcgaggccctcccgcttgccaacacgccagaagtgtttggtctccaccccaacgctgagattggctattacacgcaggcggctcgagacatgtgggctcacctgctggagctgcagcctcagacaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtgaccgagagtgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcaggaagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagt

SEQ ID NO: 565 - DNA, 2821 bp, Homo sapiens
actggatcaggggatccccaaagaaagcaaggggaccaaggccgggactgctgggatgaaggtccgggaggctgagcacaggccatggaaaggaatgacatcatcaacttcaaggctttggagaaagagctgcaggctgcactcactgctgatgagaagtacaaacgggagaatgctgccaagttacgggctccaggaggaggagaggctcctgcaggagctgctggagctgtgccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggacccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgagtctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 566 - DNA, 2691 bp, Homo sapiens
agttttaccggaaacaaagtaatgaaaagagatgcggtggggtgtggcggggcctgccccctgccggaagaagtttgggtgcagcccagtattcaagctccaggacaaagggggcggggaggccgccactagcaaacaacctcagcttcataaatccagcagaaaggtccggggtattgttgaaaaggtcggaaggaccaagattatgtccgccagcctaagtgggacgaacaaccaagttgtgcgatgcagctttaaaggggctggtgattgacagaatggtgtagtagtagatggggtggagccgctgggtggggtcgagactggcagctgagagataccaaaaggaagaaaaaagaaaaccattgctcttgatattgctaatgccgggggaggtaagctaacgagaaagtagggaaaaggaaggttttagagttcacctccactccttcccctggctaacactctttacactcttctgccttcccttgagataattaaaatagactgtacaccggccctagtcggtgcccattccccctaactcttcactcaactacgtgtgtagtccgagggagtgaggaccccgggtccaagagctcaatcccggccccgccccgtcggcccaggccccggggctgggaggagaggatgccttcggaggcgcagaatccgaaaagatgtggttggagctggaagctgttatcctcagcaaactaatgcaggaggagaaaaccaaatactgcaagttctcacttataagtgggaactgaatgatgagaacatttggacatggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcgaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccgcggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaat

SEQ ID NO: 567 - DNA, 2384 bp, Homo sapiens
agatgagactgcatggggcgggaactagagatggaggactttcccgcgcaagggggacaggctggactgaaagaggacacgggaagaacaaagacttagactcgaagccctcggatggtggcccttgcatgcttcagttcatgatgttggagactatttccccacccttgcggaaaaaccttctctctgtgccatgcagctactgccagggatggaggatggcgggaattggcaactaaagactgtcctcctaccctcttcagtgtgtccttcagcaatatgaagttaaaaccagtcttgctctgtccccaggctggagtgcagtggcacgatcttggctcactgcaacctccgcctcacgggttccagcgattctcctgcctcagtctcctgagtagctgggactacaggctcagagaagcgcatgaatgagctaaagccacaaagcgcggggctggaggtttggctcccaagaagcgaggaaatgggttcggaactcttctgccaagtcccagtagatctacccggtaaacttccggtgagtttccaacttccgtgcggggcagcagcttcggctggtcctaagcggaccggaagttcgtcaagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacag

SEQ ID NO: 568 - DNA, 2878 bp, Homo sapiens
atttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaagttaatttcattttttcattaatgtcttcctaagttctatgctttaaatgccttgtttttaataacgggaaagttctcagctgcattttcacagtggcttattcagtttttctttaatatttaccatttggtatcaattcagcattccacttaacattttataaattccataggaacatgcctgttttggtagttactgacttaatttgttagtgccacaaggaaaatattttacagtattttatgccatttaggctaaatgaataaactgttttccaagattttcttaaaagattatcaatttaaaagtatgatcaagtatgcctcaaaaactagaaacatttcaaaatgtagaacaaacgttgaaaaattgttttgccaggaaagagttcaagttcagttaaggatttgagaggcttttaaacaaggatcagtaggatagttatcatatttacttaatatatgtctgatattcagtgctggttctttttcctgtttgtgcaacaatgaagtgtgtcatgtgtgttttatagcctctatcattaatcacaccagagtctcattttaaaacattttaatgttaaaacatccccacacttatacacaggtaaaattagtttttttttttttaaagttgtaatctgtactttttttttttgcaatttttgaaacagctacattaatccctaaaaatcccaccatactgaaaatgtatggcgtgtattttctatagtaagtaatatgaggaaaacatgattagctgtgccaaagaaattttatacattgtttacatgatgaggccacagtacttactgaggacttcatatggtttttttgtttattattattgagaaaagagctgaggttaccacattcattctttgtgttagaaatgtaggagtgtggtggttttctgcaatatttagagcttagtctcataatttggaatttaagataataagtagtaacaaggcaagtcttttatgtaagacagtcaaacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggacaatggaaactttgggagaagggagtgaggaaatggataaagagaaatttgaaaattttaggctggacttgagcactattgctgctttcctatgaactatcagaatgtttaaatgctttatcattcatggtccactctcaaccaacatttattatcctttagtaattaaacaatggttttacatacatttttataatgtagaaggaaattcaagattccataatcgtaaaatttttcagatttgtctaatgtgtaatttgtgcatcttcacatgctgctaaatgcagatttaaacattacatctgaggatcatgacttttcctcctttcttggagatcttggtataaaattcatctgctgttataaaatcaggtttctacagagttcgtttcacactaaaggtagtttgttactgtttgcatgaggaaaccatgtatgtctcaatctttaattttaggtggtagtgtttattgttcaccctccctcttgcctccaaaagaatgctgaattatacgccaatatttccatgtgtattctgttgccttgatgcgtactatacttgttgcatgtatattaaaaattttgtactatg

SEQ ID NO: 569 - DNA, 2898 bp, Homo sapiens
acaaagggcccgcgcgcagccgccgccgccgccgccgcgcgaggagccaggatggtcctggtccacgtcggctatcccgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccacccccttttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagatacatgaccgtgtgtgtgtgtgtgtgtgtgtgtgtgtgtgtgtgtgagagagagagagcgcgcgcgcgagagcatgcttggttttctgtggtttgctttttttgaggtatatgtgtgttttgtgttatgtgtgttttgtatttcttcattttttggtcattagtaccgatggctggctagctgggacctgggtctctgccctatcccatgccccagcccccaccctctcgtgggcacttgcacgattttccatcccatccttttttcgtctttaaccctttttgtgcatcgcccttgtgctattgccctgctcaccccgccccccgcaactgcctttgtatgacagttgcatacacgggttcaagatgcttgggcgcgtgtgtgtgtgtgtgtgtgtgtctgtatgtgtgtgtgcatgtgtgcgagtgtgcgcgcgcgcctcggagagtcagacctgcgctgctgtgccctccttgggtccggctggagcggggcgtccggcccttgggtgttgtgctgtgtgtgaggatgaggtgggaagctgcccccacgccaggcctttgccccgggcagcggttgacaaagcagcgggccggcgcgggctttgtttttaactgtgataaatggggtgtgtttgcacggtcccctttccccacatcccctctccctcacattctgctacaacaatagcttgattttcccctcttctccccacctccactccacatttctttcattttcttttaataaaaaattcccacctcccaagcaaatccgagatgcatttagattcattttttttcttttttgtattctgcctctggactcacatttctcgtcttggaaatgtttcttctatcctctcccactccacgtctgcttaaatccctgctggctcaggccctcctccccctctccccactccctcatacacagaatgatgtcttcccttggccgaccagggctcctctaccaagtcggggtggggggtggggtcgcagggccagcgctttagtgcgccccaggggcccgattgggcaagaaaaggaaagcccagccctattttatccagcccagctgtccccagccccgcgcctctccccagaacctaaaaggcaagcttggcccccttaggcctgtttgaaccgcagttttttgtgtgatgatagaatgatgacattctgcatttatcaaatctttttttttcttcattgtgtagctcagtgaatggtcaactcgctgctgtgtgcgctgtgacccttctgcctccgcatttagctgtattgtgacaccctcttaaccatttcctgtctccatctgaggaaggcattgctatttaagcggcagtatcccctatctcaggccagcctagccatgggggtgagggggagtgggtgtgtgaggaagaaagaggggggctggatgcgatctccttgaaatgccaccccctctctcaatacacaattatctcttattacttggcatttcctcttaaaacgggtgtggaacattacactaggcagaaattcaaaaatgattaagaaggatgttgagcctgaaagtataattatcctgattaaatcattaccatcctcattaataccaccaatctctaaataccattgcaggatgctgattccatgttttgaaattcaaattgctcagctgcctttaaattttatttttaatactaccttctccctcaccccccccaacaaaaaaaaatccaacaacacaaattctgcccatcagttaaagtttactttcacggcaaacatgcccacaggaaattcaagggctgaggggtgagttggtctgtgggtaaaatttcgcagaatgtgataagagttcatgaccttccgatagaggatactaatgcttaactcaacaaggtcctaaaccacaatcttcttgtaaaactattagagagtttgccagcttaaatctgttctttttagtttccattgtagtagtgtaggatgtaggccatttcagaatagatgtagagaaataaccatttttgtatcttcatcttgtttagccgagtacattgcactgtaaatccctgttaagtggattccttttgccttggcttagaggctgcagcacttcatttttcagttatctgggtgactatcagttagcttcttggcagcacccaggcataactggagattgcacttagttggaggcaaaaaatgttaaacatatgtattaaaaaaatctttgatgaaatgacagttgctgctatcccatagcctctgaaaacttggtgcaccaaggtccctggcttaagtgggagccatggccatagcgtcttaattgtttaattgtacaatgtcaagagcatctttggacatccgccctggccctcagagctgcccctttaacagccggctcccttctgctgctcgccagccagacctgcttgaaaactgaaacaaaacagcagcaataat

SEQ ID NO: 570 - DNA, 3560 bp, Homo sapiens
ctcagaactacgtgagtcgagctgtgtctggacgtatcctgcctctccagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaggaattgggtggagaggtattactcagacatagggaagatgccagccatcagcgaccaagacatgaacgcatacctggctgagcagtcccgtatgcacatgaatgagttcaacaccatgagtgcactctcagagatcttctcctatgtgggcaaatacagcgaggagatccttggacctctggaccacgacgaccagtgtgggaagcagaaactggcctacaaactagaacaagtcataaccctcatgagcttagacagctgagaaccgtccttccagggtcgccctggagggggacacaccaagccgtgcctcagtctagattatcatctttaccaagtgcaaattccgactggcatcagcagcatcccctgagcagcgctatttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccctgccagtagaaagccaggcaggagaaagaatagcaattacattccaccatggagatgctcctgaccttttcatctgaatcctagtagcagaaatgtaacacagggggaaaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccaccatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagttcatggagcatccggtacttttaagaacacttgcccctttggatatgaatatgtgtacatgtgtgtgagcacatgtatgtgtgtgtgtgtgtctgccccaggtgtaggcggaaagctcaaaaggatttcttgtcctttgtaggaggatttttgaagtgttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcgttggaagaggaagaaaaaaaataaataaccaaaggttttggcaagtgcagtaccaggtggagaagcttgacttttctatccttgatcattttattccctcccaagaagtcagtcacaggacctggaaggccagaaagggtgcatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttttgcacagttaagagaaaaaatcaaacaagcagaaaaaaaaaagaaaaaagacttatcacggttctgctgaagcttttattttttactggatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtaggtgggttgtttctgccgctctgtttgctgcagtccccgtggcctgcttggggactgagaaatttgagccaggtatccagagccacagcccatcttgcttataaaaattatcttctgctgtt

SEQ ID NO: 571 - DNA, 2736 bp, Homo sapiens
aaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcgtatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaagaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaatattttc

SEQ ID NO: 572 - DNA, 2523 bp, Homo sapiens
caagccttcacaaacatcagcgagtccacacgggaaaaaagccctatacgtgtgatcagtgtggcaagggattcagttatggctctaatcttcgcacccaccagaggttgcacacaggagagaaaccctacacttgttgtgaatgtgggaagggtttcagatatggctcaggtctccttagtcataagagagtgcacactggcgagaagccatacagatgccacgtgtgtgggaagggctatagtcagagctcacatcttcaaggtcatcagagggtccacactggtgagaaaccctataaatgtgaggagtgtgggaagggctttggccgcaactcctgtcttcatgttcatcaaagagtccacactggagagaagccctatacgtgtggtgtgtgtgggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggacgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtaatgtgtgtgtctcacatttttatcatgtttttatgactgttttatcttgcaggtaagctttacagctttcagaggagttgtagtacactacagaaatacgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgacttttttttttttaccactgatagtatttcatatggtccctcagtaatatttctcagagatggttaaaaataggttctgagtcatcttaagcatatttctaggaatttgttttattgctgtcatgaatataatggttttgctccagttcatttcatggtttaacatatcaaatattaggtatcttaaaaatcacaaatgctatttcaccctgcaggttagcagtattaaaatagaaacatcaaatcccccatcagtgggggcggggggggggttgtagaaacagtctgatatggtttggctctgttccccacccaaatcccatctcaattttaatccccatgtgtcagaggagggccttggtgggagatgactggatcacgagggcagatttctcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggcggagtttttaaatttaaaacatttttaaaatagcaaatgttaatattccagtttccattggtaggaaattttttaggtaagttcaggcatatgtatgcaatggaaagccactagaaatcttcaggcacacagataatgacaatgcaggttgctcatgaagtatttagtgaaccaggagagttttagaacaacaattatagcatgaccccattttgttagtatgtttttctgtgtgtatgtttagagcaacagagaaaaaaagatgtgggagaggacatataactacttatctctagtggtgggattctgaatgtataatacatatgttgtacttttatgtatttcactttgtaacaaagtatctttcagttttataataacagtagagctattttttataaattagcctgatggaacaatcccttatgattaaagattcatgttgtaacctct

SEQ ID NO: 573 - DNA, 2164 bp, Homo sapiens
gacaccccagctgctctggcaaggatgggcagtgataagaggagccccgagcagggaggctggggcctgcagtttcacgcagctgtgaagtgcaccggatggagtctgtaaagtgctgtgtgaagcttgctgcagctgagtcccatgggcggaggaatgggagacgtgccgcagatgaggcagagccagcctccccagctcctgtcttgttgctgccctttcccagtggaaggctggaattacagaccattaaagctgggagggggccttggacctcaccaggccagcctctccatcctacagacaagaaaccgcagtctgacctaggggacaaatggccctggcaccgagactcttccaggccccacccaggcgctgtcgctgggccctgcctctcgttgcagctggcttgcctgagttattttctgttccgtctgtaatgatcctattgtcacaatgggtctctcccagtaagagtgcactccacgcatcccctgaggtcacctatgttctctgcacacagagtgcttactaaatgagtcttgatggacaggcgctgcagcctgcagagacctcatctgatgtctcggccaggccaatctgccctttccagatgaccttctctcccatcccttaaaagtgtcctgtgatgctccccagatgttctgcagaagcatccaggagaaccgagcccccagggcagagcggcactatgcaggcgccaggccttgcaagcccagcatcttggaactctctttgcacagagttaccttgagccaaatacaagtttctagaatctggacacacgacacagtctcggcaaagctgattacagaggagtgtcagcgaagttgttggaaaaaatatcttcaggaaaagagtgtttggcagcttccctgaggggtaaacaagccaacagaaattaatcaggagaatccaggggcatgtaccagtaaagcaggggcagctcatcccaaagcatttgcctgttttgtgtcttcctaatacactagccaggagggaggaagacctgcatgcggactaacagaaaccattttggaagacaatgtacatgcagtttaacctctttaaagtgaccttgttagacaatttggccactaacatctcccatggaattgtgagatatgaaaaaagcaccagatgcggctgtttggcagagtcctgtcctggctatgggactcgttctgaactgaaagcttctagtcggcctgttctcagtactggctggatgaggcctggagtcaggagtcaaaagcccaggtctaaacaagatttgtctacctctctgtcacctaagcaggacatgtggtgagtggttcatctgtgggtgccctccttccgcacctgtggaataggatttgccctgcctgtctcacaggcctgctgtgaaggctgaacgaggagcacacgttcatcaagggtgaagcatggtcaaatgtcaggcaatacgattctactgaactgcactgctgattgaaaaaagcaatgctctccttccgtgaaaaatgactaaactctctttatcaggtgcgctcattaagacaaacatacacaccccttgacacccccttactagcccccaacacacagaaaccacaccagatattttcagcaagaacttaacataggaaattgggtggctacaaaactcttgcaagggctaagcgttcatggctggtcagccaggagcaacttctagaacgcggcagaaatgacaaaagagaggagcttgggcccctgaggtgccccttggagctctgctgcctgcaccacaatgaactctgggagaccaggacccaggacgctggatcgagaacgctgcaagtgccacttggcaaacacacagcaaacaaacgcaatctaatctctactacatcgctcctgttaaacagccaaaatgaagcagaaaaatagctccacctcacttctctcctacaaatctcccatcctgttggccacacccagctccatggatgctgggaaatgtagttactatctgggcaaccatatgccctgaaaaacctcaggaggccctattgctaagagaacaaaagggaggatgaacattggggaataattggccatgtatgccacacttactcacttcataaaagtacaaacaattaaaagctcaaattagttg

SEQ ID NO: 574 - DNA, 3089 bp, Homo sapiens
acacaggcgcagtcagggaggcagggtgtgtcgagcggtttatcccgcaaccccggcgtccccggcagggatgaaagcgcagggcccacgcgaactcggcccgcagctcccggccctagaggacgcactgtccgccggcaggggcgtgcccaagacgccatgctctgggagaggttgggcacctggcaggccgccccgactccggatcagctgtctccgctgcgtacgtcttcctcttccaatgggcttggattgagccttctagcgcatattccaagtcctccaatgtcccacaatgccttgcagccggtttcgccctcggtcctggcaactgtcgcgtaaccacccatgaaagcgtccatgcctcgccgtgcgatagtatctccggaacaaatttgtccctctgcgcgatccggaactccgaggtcgttcctacgcgccgtcgttcgcctcttcacatcggattgggtctcacgcaaggatgaggcggggtttcgccgtggcgcgcatgcgtgcagcaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactggtgaggggcacgcgtccggggagggatggggccgtgaccgcggggtcgcaggaggcgggcgtggcctcggcctccgtggggaggagggcagtctgaggagtgagcttcagtacaccagggcgcggcccccagacaaacgagggaccgacggcttgatctgaggggtagggcagctttgcgcctcgggcacaggatcctcgccccaaagccaggatcctgacgctgaccttgtggactccatgcccatcctatctgtggatcccgggtggaacctcagctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcaggtagtcaggggctggagagagataccacacttttataatcaaatgcctgtgaggttatgtcctggctcccactgagctcagccacatctgcattggatccagtcactggggctggagggatttgaggaggagtttctttaggttccttgttgcctcagctgtacgtgttcattgttctctgctgttacaaagcttcaggaggaaagtgccattgggcatagacactgggtacaaatcctggctgcacctagcctgtgggccttggataagtctctttttttcttttttttttttccactctctctctctctctctgagcctcagtttcatcatctgcaacttgtaggggtaatgccagttttacaggctttggggctctgagaaagtacctgtgagccatgaagacgatgtcggttggttttcatagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagtctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaaggtcagggtggtgcaagcactggcttggaccctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagccc

SEQ ID NO: 575 - DNA, 2643 bp, Homo sapiens
agaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacaggttcccttacatgcattgcgaatatccaaaagagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacgtgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctctgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctagaaataagataataaatattaacaaactttgctttttt

SEQ ID NO: 576 - DNA, 2480 bp, Homo sapiens
gcattcggatccgctagagcaggaagatggcgacggacggcgcgagctgcgagcccgacttgtcccgggccccggaggacgcggcgggggccgcggcggaggcggcgaaaaaagagtttgatgtggatactctcagtaaatctgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgt

SEQ ID NO: 577 - DNA, 2693 bp, Homo sapiens
aatgcaactattacaagttctcagtgatgttctggctgagattgacccaaagcaacttgtggatatcagagaggagatgccaaagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctgacttcaggtgatctgcccacctatatagcatgagtcctgttttccacttgaaactccaagcatacctgacatataacagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggcttactgtttttcttaatctcttttaaaaaaactttagaagaatcttttaggaactaatatctcttgttctgaagaaacatttatctgacgttcagcagttcctacagttttactccagtttatttttcttctgtaaaatgcaagaaaatttaatattttgactaacatgtcttttctgtttgtatcatttaaaggcaaataaacttggtacgtatttcatatctattt

SEQ ID NO: 578 - DNA, 2777 bp, Homo sapiens
tgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattactcgtagaacacttctcaaccataaaagcatccactttggagataaaccctataagtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaagacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 579 - DNA, 2494 bp, Homo sapiens
ttgttaaattttctggagccatcacagtttccttcagagaccgctttcttggaggaatttggagatctgaaaacagaggagcaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagtgaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaggcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcaccttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatc

SEQ ID NO: 580 - DNA, 3165 bp, Homo sapiens
actctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggttcatcacttaatttcctcttctgcataaaaagtatagtaaaaacttcgttatccaatgcaggtgaatccgaatcttgaactgcctatgttattgtcctacaagcatactgacagtggttacagctaaaaaagaaagcatgaagaaacaactacaaaaagttatcatctcaggatacttgatatgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccgtgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatg

SEQ ID NO: 581 - DNA, 2498 bp, Homo sapiens
cagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttaaaagtgtaatgagtgtggcaagaccttcagtcagatgtcaaagcttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaagacaacccttgcacgtcatcatagaattcatactgcagagaaactttacaaataggaagaatgtgacaaagttttcggttgcaaatcaaaccttgaaacacataagaaaatgcatactgaagagaaaccacacagatgtaaggtttatgacaagatttttgaatataattcatacctggcaaaacatattagaattcaaactggagagaaaccttacaaatgtgatgagtgtggcaacacctttggtcaaaattcacaccttgtaattcaaaaggcaattcgtactggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccatttcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcgtgccaccacacctggataattttttgtatttttagtagagactgggtttcactgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcaatatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgatattcttcacagatcatgtcatctacaaacaaataaaatttgacttctttctttctg

SEQ ID NO: 582 - DNA, 3431 bp, Homo sapiens
gcttttgctcggacctggagtaatgagagtggacgtttgattccaacaggatggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagagtacaaagaaatgatgcattacctgaagaacattatgatagctgtggtcgagtctatgattaacaagtttgaagaagatgagacacgaaatcaagaaaggcagaaaaaaaatccaaaaggagaaaagccatagttaccgcacagacaattgctctgatagtgattcatcattgaatcagagttacaaattttgtcaaggaaaattacaattgattttagaccagttggatcctgggcaacctaaagaggtgagatatgaagccttgcaaacattatgttcagctcctccatctgatgtcctcaactgtgaaaattggactactctctgtgaaaaactgaccgtgtctctttcagatcctgatcctgtgtttagtgaccggattttaaaattctgtgcacagacatttttgctttctccattacatatgaccaaggaaatttatacaagcttagctaagtatttggagtcatactttctttctagggaaaatcatattcctactctttcagctggtgtagatataactaatcctaatatgactcgcttacttaaaaaggttcgtcttctaaatgaatatcagaaagaagctccatctttctggattcgtcatccagagaagtatatggaagaaattgtggagagtactttgtccttgttaacagttaaacataatcaaagccatgttgtctcacaaaagattttggatccgatctacttttttgcattagttgataccaaggctgtgtggttcaaaaagtggatgcatgcacattatagcagaactacagtattaagacttcttgaaaagaaatataagtctctggtaactacagccattcaacagtgtgttcagtactttgaaatgtgtaagactaggaaagctgatgaaactttgggacattcaaagcattgcagaaacaagcagaaaactttctactacttaggacaagaattacaatatatttatttcattcactcactgtgccttttaggaagattattgatctataaacaaggcagaaaactatttcctattaagctgaagaataaaaaaggtttggtatccctcatagatctgcttgttctttttacccaacttatctattactcaccaagttgtccaaagatgacatcagctgcccattcagagaattactctcctgcgagtatggtgactgaagttctgtggatactcagtgatcaaaaagaatgtgcagtggaatgcttatataacaacattgtaatagagacacttcttcagcctattcacaatttaatgaaaggaaatgaggcatctccaaattgctctgagacagctttaattcatatagctggtattttggcaagaattgcatctgtagaagaagggcttattttactcctttatggagcaaatatgaactcttctgaagaaagtcctacaggtgctcatataattgcccagttttcgaaaaaacttctcgatgaagatatttctatattttctggatcagaaatgttgcctgtggttaaaggagcttttatttctgtgtgtcgtcacatatatagtacatgtgaaggtttgcaggtgttaatcacttataatttgcatgaatctatagcaaaggcatggaaaaagacaagtttgctatcagaaagaattcctactccagtagagggttctgattctgtttcttcagtaagccaggaatcccaaaacattatggcttgggaagataatttgttagatgatttactacattttgctgccacccccaaaggattactacttcttcaaagaacaggtgctatcaatgaatgtgtgacatttatattcaatcgatatgcaaaaaaattacaggtcagcaggcataaaaaatttggctatggagttttggttacacgagtggcatcaacagcagcaggtggcattgcactaaaaaagtcagggtttattaatgaacttataactgaattatggtccaatctggaatatggaagagatgatgttagggtaacccatcccagaactactccagtggatcctattgaccgaagctgtcaaaagtcttttttagcactggtgaacttgttatcctatcctgctatttatgagcttgtaaggaatcaagatcttcctaataaaacagaatattctcttcgtgaagtcccaacatgtgttattgatattattgatagacttataattttgaattctgaagctaagattcgttctttattcaactatgaacaatcacatatctttggtctaagggactttataattgatggcttatcagtggagagaaatcatgttcttgttagaataaatcttgttggtgggccattggaacggattttgcctccgaggttactcgaaaagagtgataatccatatccttggccaatgttttcatcacatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgctaacaatactgaaattagctgggtgcagtgatgcgcctgtagtccctgctacttgggaggctgaggcaggagaatcgcttgaacccgggaggcggaggttgcagtgagccaagattgtgccactgtactccagccaggccacagagtgagactctgtctc

SEQ ID NO: 583 - DNA, 2707 bp, Homo sapiens
ccttccagccatgatgccgaagaggacgagccactgaaggagtcccgcaggaaggaggccttcttctgtctggagttcttactggataacggtgcagacccctccctgcgggacaggcagggctacacagctgtgcactatgcagccgcctatggcaacagacagaacctcgaactgctcttagaaatgtcctttaactgcctggaggatgtggagagcaccattccagtcagccctttgcacttagctgcctacaacggtcactgtgaagccttgaagacgctggcggagacgctggtgaatctggacgtaagggaccacaagggccggaccgcactcttcctggccacggagcgcggctctactgagtgtgtggaggtgcttacagcccacggcgcctctgccctcatcaaggagcgcaagcgcaagtggacacccctgcacgctgctgctgcctctggccacactgactccctgcacttgctgatcgacagtggggaacgagctgacatcacagatgtcatggatgtctatggacagaccccactgatgctggccatcatgaatggccatgtggactgtgtacatctgctgctagagaaaggatccacagctgatgctgctgacctccggggccgcactgccctccaccgcggggcagtgactggctgtgaggactgcctggctgccctgctggaccacgacgcatttgtgctgtgccgagactttaagggccgcacgcccattcacctggcctcagcctgtggccacactgcagtactgcggaccctgctgcaggctgccctttccacagatcccctggatgccggggtggattacagcggatactcgcccatgcactgggcctcctacactggacatgaagattgtctggagttgttacttgaacacagcccgttttcgtacctggaaggaaaccccttcactcctttgcactgtgcagtgattaataaccaagacagcaccacagagatgctactgggagctctgggtgccaagattgtgaacagccgagataccaaaggacggaccccccttcacgccgctgccttcgcggacaatgtctctgggctccggatgctgctgcagcatcaagctgaggtgaacgccactgaccacactggccgcactgcgctcatgacggcggctgagaacgggcagaccgctgctgtggaatttctgctgtatcgagggaaggcagaccttactgtgttggatgagaacaagaacacggccctccacttggcttgtagcaagggccatgagaaatgtgccctcatgatcctggcagaaacccaagaccttggccttatcaatgctaccaacagtgcgctgcagatgccactccacattgctgcccggaatggtctagcttctgtggtacaggccctgctgagtcatggggccacagtgctggctgtggatgaagaaggtcacaccccagcactggcctgtgcccccaacaaagatgtggcagactgcctggccttgatcctttccaccatgaagcctttcccacccaaggacgccgtcagtcctttcagcttcagcctgctcaagaactgcagcattgcggccgccaagacggtgggtggctgcggcgccctgccccatggggcctcctgcccctacagccaggagcggcccggcgccattgggttagatggctgctactctgagtagccccctccagtgtccctcccccgccggtggcttgatatctaattctatttatttagaaaaagtctaaacatttagggcactttaaaggagaacacgactgggtggagggggcggaggggaaggaagccctggggagcagctgctcacccctttgccacaccatcttggcctggcaggggtctgggactgacagggagcaccccaggcccttggtacccccagggcgaccccttctgccaagtgtcccaaaatgattgctaaatgcctggctcccccactctttgactccatctcttggttccctctttctgctgccagctcccccgactcttccctggggactcctctctgtgtcccccttctcccctgcccctactgccaggcagatcccctcttcttccatacccatcactgcctccctgctcggccggtccctccatccccgcagcagtgagaagccttaatttctggtactgtgtgagcactctgggggtgtccccctccccccttcaggggcagctagaggatgaggggggaggatatttagcactggggcctggagctttttccccacttctgtaccctatcacccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtagcaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctc

SEQ ID NO: 584 - DNA, 2374 bp, Homo sapiens
acataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcgaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcac

SEQ ID NO: 585 - DNA, 3120 bp, Homo sapiens
tgctgctgcctggtctggactgtgaacctcggcagctcaaacccgaacactgtttcagttccttccggaggctggatgcccgagcagctactgaaaaattcaaccaggacctgggtttccgcatgctcaactgtgggaggacggacctcatcaaccaagccatcgaggccttgggtccggatggggttaacaccatggatgaccagggtatgacgccactgatgtacgcctgcgctgctggggacgaagcgatggtccagatgttgattgatgctggggcaaacttggacatccaggttccaagcaactcccccaggcacccttccatccaccccgacagccgacactggacctcactgacattcgctgtgctgcatggacacatctctgtggtccagttgctgctggatgctggtgcccatgtcgagggctcggcagtgaacggcggcgaggacagctatgcggagacgcccctgcagctggcctctgcggcagggaactatgagctggtcagtttgttgctgagccgaggcgccgaccccctcctcagcatgctggaggcccacggcatgggctcctccctccacgaggacatgaactgcttcagccactcagctgcccacggccacaggaacgtcctgaggaagctcctgacgcagccacagcaggctaaagcggacgtgctgtccctggaggagatcctggccgagggtgtggaggaaagtgatgcgtcgagccagggcagtggcagcgaggggcccgtgcggctgagccggacccgcaccaaggccctacaggaggccatgtactacagcgctgagcacggctacgtggacatcaccatggagctgagggcactgggagtcccctggaagctgcacatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgtcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggttcaagacactaatgaccaataaatcagaacaggatggggacagcagcaagaccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactccccctgggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatg

SEQ ID NO: 586 - DNA, 2596 bp, Homo sapiens
gataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaagtaactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaacccttat

SEQ ID NO: 587 - DNA, 2642 bp, Homo sapiens
aacactcaccaggaagttgatgtcggccgggcgcactaggcggtagctgcacgtcgcgcaatcctgactgcattcggcccgcacggtcgccaggagcccggggccgagcaacagcagccaagtgcaaagtgtcaggaaccgcgccatggactgcgaggagagagggacgcgtgcttcgagcctgcctgggcgcagaacgggtccctcggcaggaccctcgccgcgacagcctcagcaggggatcgtcgagcaaaagcccgcaggaatgctcctttctggggccccgccctcccggccgacagcttttaggtagacctggaggcgactcagatcgcctcgcggttcccgggatggcgcggtcgcccccaacgcgaggctgcctggggcacccggctcttttcctgggcgtccgcggcccagggcaagattccggagagaacgccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggaagctgaactgacacgaaacaaaagaagtccgttgttttggattgagttccatacttggctggcccagaggttgatctcaccaccattcagatatccaagaagaagccacctgttggatttaagaaaacccagtcaccaataatgtggaatccatttcgtggagacaagctacttttagtcaaaaattgtaaggcacggtttgtcaagatggccgatacacaacagctccagtctacgcatcccagcatgagcgatgcagaagacgggtgatttctgcatttccaactgaggtaccgggttcatctcactgaggcttgtcagacagtgggctcaggacagtgggtgaagcccactgagcatgagccgaagcagggcgaggcatcgcctcacccaggaagtgcaagggatcagagaattccctttcctagccacggaaagctgtgacagatggcacctggaaaattaggtcactcccaccttaatattgcgcttttccagtggtcttagcaaacaacacaccaggagtttatatcccgcgcctggcccagagggtcccacacccacagagtctagctcattgctagcagagcagcctgagatcgaactgcaaggcagcagcaaggctgggagaggagcacccaccattgctgaggcttgagtaggtaaacaaagcggctaggaaacttgaactgggtggagcccactgcagctcaaggaggcctgcctgcctctgtagactccacctctgcagccagggcacagctgaacaaaaggcagcagaaacctctgcagacttaaatgtccctgtctgacagtttggaagagagtagtggttctcccagcacgcagctggagatctgagaatggacaaactgcctcctcaagtgggtccctgacccccaagtagcctagctgggaggcattccccagtaggggcagaatgacacctcacatggccgggtacccctctgagacgaagcttccaggggaaagatcaggcagcaacatttgctgttcagcaatattcgctgttctgcagcttctgctgctgatacctaggcaaacagcgtctggagtggacctccagcaaactccaacagacctgcagatgaggatcctgactgttagaaggaaaactaacaaacagcaaggacatccacaccaaaaccccatctgtacgtcaccatcatcaaagaacaaaatgataaaaccacaaaaatggggaaaaaacagagcagagaagctgaaaattctaaaaatcagagtgcctctccccctccaaaggaatgcagctcctcgtcaacaatggaacaaagctggatggagagtgactttgatgagttgggagaagaaggcttcagacgatcaaacttctccgagctaaagaagggagatcgaacccatcccaaagaagctaaaaaactttaaaaaagattagacaaatggctaactagaatatccagtgtagagaagtccttaaatgatctgttggagctgaaaaccatggcatgagaactacgcgatgcatgcacaaacttcagtagccctgcaagagctcctgagggaagcactaaacatggaaaggaacaactggtatcagccactgcaaaaacatgccaaattgtaaagaccatcaaggctaggaagaaactgcatcaactaatgagcaaaataaccagctaacatcataatgacacaatcgaattcacacataacaatattaaccttaaatgtaaatgggctaaattctccaattaaaagacacagattggcaaattggataaacagtcaagacccatcagtgtgctgtattcaggagacccatctcacgtgcagagacacacataggctcaaaataaagggaaggaggaagatctaccaagcaaatggaaaacaaaaaaaggcaggggttgcaatcctagcctctgacaaaacagactttaaacc

SEQ ID NO: 588 - DNA, 1201 bp, Homo sapiens
cttcacttcatctcttccccctcacccacagcagcactggctccttggtgtgtgtatggccgaagagggcctggacacagggtaccctgggtgaaagatggggccgaggctccaaggctcctgctgtacttttcttctttttgagcaggagctggagggtgcctcaggaatacaggagggacatgggaggagggctgttgggctgagggctccctgtctggctgccatctcttcttcctgctaccctgttcacaaactgggggtgcttaactccctctgtgaatcaacatgaagtcactgctggcaacctagagcctgcgagacatctggccctgatggagggggagggaaaggtgtctggaacccaaactttctgcattatgatccccacccccaacctctctcacgtacacctgcgtgttcatgtacacatacatgtacatagcatcccttgagctgtcctcacctgacctactgaactctgaggtggtccgggtcccccagagatggctgggtagctggttttggcagcctctacctgtgaggtgtgaagttgggggctggggtggcaggtgagtgggggggatggtccttggagctggctggggctgggcttaccagctccacctcctgcaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctc

SEQ ID NO: 589 - DNA, 1360 bp, Homo sapiens
tttgcattatcaactggggactcctggaaatgggggtgtctccaagagatatatttgatacacgtccagagaattcctgaaggaaagaatctggggttgtcaggctgatatcatgaaccccacatttaacacattaagtgaagagaggggacaaaggccaggcttgggaaggaaggagggatcaacaaagcccttacccaggacagataaaaatgatagaatggcagtaaccccatttggagcccccatttgtagtcagcaagcaaagtactggtcctttttacaccttatctaaccatcgagacacgcccctgtggttggtatcattatctcagtgtttgagcagggaaacgtcacttcccagaggacccacagccagtactcggcagagctggaaatcaaacccggtccatccaaagctaaagccagatgtctctttactggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagcaagtctctctccttccctggtcctcagtttccccatctctattggggaagggttaggtatctattctagttgattaattgccagggcctgagctctgatggtccaggattctgtaagtctaatgttaggtcccacggcttgccctgctcagcacctaataaggccattagctctggctccttctctctggggtggcagcagggacagaaaacaacagagatacattctcttggcagcacagaactcagctcaagggttctggggatggggccttccctcctgccagggaggccatctcgagaggctgactgctcacacctgggcagcactctgtctcctcccctcctgcctgggtcccagctctgttcaccaccccaaagcacatcaccacaaggtcagttgcaaaggcccggtatcacaggcttaaatacagagggctaggagggaggtgggaggtgggagaggaaggtggagtactaacaaaggtgttgaattatcactgcccatcaggacacggttatttccccttactctgggacaccaaagattctacacaatcttcctataatcctgaaccacaaaagggaggcacagcctccaaaaaaaagtaggagaggggaggggggaagtacttttattttgaaatgtgttcatttttctttgttttattttctatcttgatgaaaagaatatatttttaaacct

SEQ ID NO: 590 - DNA, 1230 bp, Homo sapiens
aaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatattaatggatcttataaagtacttgtgtggagctttgattccacagaataaaagatattttgtgtgtagatcttc

SEQ ID NO: 591 - DNA, 1820 bp, Homo sapiens
tgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgctttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgc

SEQ ID NO: 592 - DNA, 2363 bp, Homo sapiens
taggacagaaatttaccctgcaagatactttcatatatgaaattattctcttttgaaccttccttaccaaaaatacatcttcatagctaacttttttcacatctctcctacttactggttttctaccttctttcataactaacctttaaataacatccaaattaaataaaattattctttttctccataagaacacatttatttggcacattttatatatagaattctatattaactaaaattcttactcttagtaaccttaaattttagtgaaaacctaggaggcaagaaatattgaattgtctgttctctatcagcactttaaagatgagaatcacgtcacaatttttagaaacgtgtttctggccaagcatggtagctcatgtctgtaatcccagcactttgggaggctgagtttacattctccccttttagccaagatgtgccagagatgacattggtgaccaaacatttattttttcccatatctttgccggggtggtgtggctacctgctgcaggttcattctgttctttggtgggatccttatggccaagggacttggagccaattaaacattctaggccagatgaggatggaggtgaacaggcactcattaacccttaaaaaccttttgagcaacagaagagccaaaaagcaaggttacaacagtgacttacctgtaagttctatgtgacgagtcatcagctgtttagtaacctgtatgacctgttaaccatttttgtagcctgtgaatatcagatgttcatttaagtcagaaccttaaacatgtggatatttttgccaacaactcagaagctaacaaaacagctaacaacttagctgttttcattgaaccaacaatattaaattagtcttatttgtcaaaaaattcacacaaagatcattctctttttgactgggtttatagtcttataatcttttgtgccaaatcctgataccttaaaacacctagcggaggcaagtataaaataatcagtaaacccagactaaaaaaaaaatgtatgctgacaattctgaagacatttctagttttattttaccaataattttaaaaccattttatttaccagattactaagttcacatgaatctgaaaagtatttggacttacttaatttatgagtataatttacttataaaccagtttggtaccatgctagatacaacacaacataatacatgttcatatacaaacatttaaacacatacacacaaagatcttacagcttttactctggaaccttagccatgagatggtaatacagactcaccacttaacaaaagacagctggatccaaattatttctgacaaaattgggacctgttcacatggctaaactttatttgtcccagtaggtaatccaatgaaggctatggaccaaagtcttgggaaaagtagttttcatggcagttttatttttaaaaaccttttacccctttttttttttcctgaagtttcaaatgagttttcagtgtttacattttagctacaattggctgaactgtaaagaaagctccaagtagccttgaattagtagtatcataaacaatgagttttatcttaacagcagtagcttaataacagcaaattcaaagcaggccgaaaacaaaaaagagatagctttagaaaactctacattttaattgtatagttgcaggttgggcatttgagctctgaattttccttgctgtaatttgcccgttcagttttaaaatgtgcacaagaacaggccacaatatgcagctagctgaagtgctggaaaacctggcatgcctttgaacttctacaggagttcctgcccctagtgggtaagttacctattgcactgactttatgaagatatctcttccagtgcccttagtgtgagcatccccacaaaccttatgaaccagttgaatccaacctgaatgcctctccataagcccggagcccacaaatgcattttctccagggcccttggatggagggaatcaggaaggcctcctccaaacccaaggctaggagagatgttccctccggggtccagggaggagaacagaaaggactgagaagaactaggaatgccctcccaaacccaaggccagcaggagggtctcctccggagttccacagatggaggaggcctaaaagaagaaatcaagtctgcaacctaaaagtgggagatcttggattttgatagcacttacccagatcctttcccagcatagtcaggaacaactggactttttcaaagggaccttggctgtacctggtgtcctgggtgacacaggaaaaggaattcaggggctgcttcagaatcccatctttgccagatacgttaacttcaaaaaaaaaaaag

SEQ ID NO: 593 - DNA, 2446 bp, Homo sapiens
gatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatgccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccaggtgggcgtccagttcagaggccaaagctgggctaagaggagggggtgcgctggggaccaggaaggcgggtgtgcctaagggaggcccaaggcccaaggcctagggcctgctattgcaagcctaaggccaggcagttggacccctgggcattcttggtgtttatatccgaggctacaggtggatgtgggtgtaactctggatagctgggtatttgagggagatggtgtaagactgtaaatgtgtctcggtgtcttttgtgtggagatgcatgtctatggaatccattgttgtgtgtgggagtagcaaggaagctgttttgtgcaggcccagaaatctcttggaactcaaaacatgtccctagtcttcctcctcttgcagctgatccagcctccatgcctcaggctgggagcatcaaccctgggtggaatagggactgtcccttcctaatcacgtcccagcctgacaccatttcagccttgggcctttgggaagtctaatttatacagctgacctatccacctgaaaagatagtctctcccagttttgccccctctgccttcttttacccaactgatgggaggtttgaggggaggaggcttccctgtaaatgaaacgtttctgtaaatcaaattacatttccttgcatcaggaaccttgctatctaaagcagtgctgtctaacaggaatattatataagccaaataggtagttttaaatctcctagtaaccacatt

SEQ ID NO: 594 - DNA, 1676 bp, Homo sapiens
cccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgttttttttttttccccacaaagtgtgtttccacttggagcaccattttgacccaggaatttttcatagtttctgtattcttataagattcagttggctgtccttttcctgctcccctcaaaagatctttagtcatacagaatgttaaattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtat

SEQ ID NO: 595 - DNA, 2990 bp, Homo sapiens
tatgaagattggtcattgctatggctgctataagaagtcttgtttcaaggatgttttttcttgttgtgacatcttgctttcttatattcatgttctcttacgtttatacccaggagtctcctctgtccttttctaatctttcttgctggacagtttttttccttaagacagctctatctgagttgtttgtccctatggcagccatgagcaatagagtaactatctttgctgtttatctatccttgacaacttgatgtccaacttggcactgaggataacttcttgagggctcatatttcctttagggcctcaactccaacaattcttcaaccccactgtgacctgaagtccatgcatcctaccccctttctgttgtctctcactctcttcatgtcccaattttctactgtttcagctcacattttactctgcattactctaattactgtcttgcattttctaggcacacattgctcctttccccttcctttgtaatcacttggcaaaagtctaacccagattacattcaactcttcatgcccatcttgcctacactcacccagctaaacacagatggagtgaaacacaccattgtgctggctcgtttcactttacagccatgactacaaaccacgcatgggtccttagagctgccgagtagtcagattatgtttctggagcccctttactctcctgttcttttaggtaaccattttataccttatcttctccctcattttcaccttcagctgattttcttgtttcttgtttctttaagaaaatagaagccatcagaatgagacatccccatgtccccatcatcgcactgtcaaccgcacatctgcactcatctgcgctcatgttctctgcctacatttctttttcttagaatgaactgcctgtgcttcctgcagagtccaagccctcctcttaggaagtcgaccgtcctctttcgcctgcccaaggacatcactctggcaactcttccccctctcctgcattatctgttggcctttctgtgtcatacacataagctctattttttccccatctaaaaaagaaactcttttgactctaggcctctccagctaccaccctacttttctactgccctttagaaaaaactcctcaaaagaattattctcacatttctgcaggataacatcacacattctcctagttctatattcttctactagctaatttctttgtaccatatttagtttttaaagagctcctttctctataaatatttcatttcaatgccagaggtcatatcagatggagaatggctggttggtggtttaacactgattaaaagaagaggaaaagcagccaaatatttagagaaaaggtgaagccattccatcccatcacctttgttggagcatttcaatttgctctctaccttagatgtgctctctagcccatagctgagctaaaggtatattaagtctgtctaaccgggcttgaagggaagctggaagaccatttgttcttttaaatctctttagtttgcaattgtcagattcaattttgaggggaagagttcagagcatcattgaaagtaaaaaagatgggggaaagtgatagccacatgataaattatatcaaagtcaaagtcaccgccctatggcaatttttgcaaagaagtatttttagcatggatagctaaagggtagagcatgtcacagagacacctgtgtagttatgcagactggcagggatgtagaggaactattagaacccctgccttgtgtatcaatggcatattttatccatgggcagaattagcagataatattcgctatactgattaggagagaagacagcttcatctccacacagctggaaatatgtcctgcttcaatgtcaatttgtttatgctgtgggccaagtcatgcccccatatgtctgtattttcacatctctaacagatattaattgcactagatttgctgtgctgtacttttgattagtcagaagttcggcctagtaagttagaactctgtgttctcactgtgttaaagggatgcttgtcattatattgttttgaaattgtttaaaagatacagttggggaggcatagtccttgatcttttaaaatccttttaaagaaatgaacggggcaattagatagcaaaactgaaaacttatgggcttttattttttaattttttattactatgggaacataatagtcatatattctttcattctttttttccctcccttcttgtttaagttaggccagagtccagttttctttatggttttttttttttctttctttccctttttttttttttttttttgcgatggagtctcgctctgttgctctgttgcccaggctggagtgcagtggtgtgaacttggttcactgcaacctcagccgcctggattcaagcgattctcttgcctcagccttcccagtagctgggactacagccgcgcgccaccatacccgtataatttttgtatttttagtagagacagggttatgccatgttggccaggctggttgagaactcctcatctcaagtgatccacccaccttggcctcccaaagtgctgggattacaggtgtgagccaccgcccctggcccctttactttttatttattctttctaatttcaacttttattatagatacagggggtacatatacaggtttgttccatgagtatattgcatcaggtatgggcatagtacccaataggtggtttttcaacccacagcctcctccctccctcccccatctatagtctacagtgtctatcgttcctatgtttatgtccatgtgtgcttgatgtttagctcccacttatgagaaagtgtgagatttggttttctaaaccctgcacgtgtacccctgtgtctaaaataaaagttgaaattagattaaaaaaaagtgaagaccctggtataacttaaacaggaagaaaaaaagaattaaagattatattactattacgtgcccatagtaatc

SEQ ID NO: 596 - DNA, 3646 bp, Homo sapiens
aacacacaatacctagaatttggagaatgctgcaagacagctttgagggcagctaccacttcttttttgcctgtgaaaattggagggaaagaactttgaattggaagaaagaagaacacgaaaagagaaagagagtgaaaggaattccatcctagtgggaatgatttaatgtgttgtattctttagggataagagtgtagaaatccagaaagcacagttctggccagacttacataggtggagcagtagaattgtcgactactattaaaaatgaattgatggtcctttcattgtatgccaaggattcttaaacagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgtttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacatgtggtaagcataggcttgaagaggtgggtaggcaggtacatgtacttcctaaatttggagataattatatttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccatt

SEQ ID NO: 597 - DNA, 3657 bp, Homo sapiens
ctggacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcggtgagtatgccctgcatgagtgggtcatctcctccagtgctggtggccaagtcctgctctcaacaggcctgggctgggagaagatacagttctaatgcaggtggaatcccaccagctttcctgagtcccgtttcctccatacttaagtaggtttaatactccagggcttctttccaatgttaatgagtaactagatttgtctcttggtgctgagccaaatgaggaatctagaagcccaacagtgattattggccaagcaccaagccaccctctacctcattttgcaaataagagatgagaggagacctctgtcacagagatatttggaaaatgtcttatttggttgaaactgcttagtgattgttttcatgacatggtctgtacttatttaggtaattgccttaccccctcctttcttccccacaaccccctgtcttggagggaaaagctctcagtctctctgttgttgccttggacttctcaaggacaaggacttttttactcctctgtttcctggcatctagcacagagagctttggtattcttaataagtatttagagattgatagaattactagcagttctgcctgacagatgtctgaatatttgccttttgtaaagttttaataagtcagttctatgggaagaaaatgtggagctcctcagactagagagagctgctcagaaataacctgcagttctgcaattagagggtgagagctcgggtctgggtggcccaggcctgggtttctccagctgggaataggacttgtgctgccctcctgagtccactagggggcgatgtctgtctgggccatgtcttctgagcattctcagaatcacggggcagcggtcagaccatctgttaatccggaagctctcatttcatggatataggctgacagtcttggccagacttgactccctttcctgaatactcttttgctgatatcatcatagcttttgatgattgtaccctcccatttttctgcattttctacaacagatccctttgggatgttgtattcctgagtccccatatgtatgctagtatttgtcagactatccctctcaatgtttgttttagaaaagtgtttgacatatagatattcagtgagagctgtaagacagtatcttcaatatctgctttcagattatctgaagaataagtctaatttagcaaatcattttattgcttctgattcttgttttaaaaaacatttgcagagaagagtctagaagctggaaggaggagaagtcagctggtatttaaagagtgcttagtgtgagcctgtaaagttaattagtgtcagaatataaaatgctaaactgcctcctctcccaagcagctctgtgtgtgtgtgtgtgtgtgtgtgtgagtgtgtgtgtgtgtgtgtctgcaactttgttaatacttattgagcaagatacttggtgttccctgtcctccttctgtcagtcaagctactattggtattcattttggtcaggtttcaccatgctaaaaatattagttgaaggaacagtgacaaggctcaggtattatggtatctctggacttcacaacccctggcgagagccctacctatgcactttaccagtctcttcatgtgcttgtagaggctttggaattgtaccttctggtggatcaaacttagttacctagcacaccagcctgctgaaatgtgggagaataaaccacacacagtcatttagggattgtgtcacatgtagaagcccattttgccccagtgtgggtctaggggagagagactgagtgatatgggaaggagccaggctaggcacaggtttttcaggccttgcctgctcctggctcagacgggtctcttgtgaagagggaggtaccttcacagtgtgagatgcctagtgtgaacagtgctggattatgtgtcttgcagttgacaacggcagtgaccagtgcctttttactagcaaaagtgatcctttcgaaggtatggcctaccactttttctatacagttaccatcttcagtgatgaagcctcgtttttcagtgtgagtttgtggtaactgcatttccctttcctggtcgtattttccagcttttctctcaaggggcttttggctatgtgctgcccatcatctcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgccatgattcatcctctcttcagtgagactgagcctgatgtgttaacaaataggtgaagaaggtcttatgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattat

SEQ ID NO: 598 - DNA, 3307 bp, Homo sapiens
agaaccgctccccgccggctgtccgcaacctccgccagcgtcggtccctgggcaggtgtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcggttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctctttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgatt

SEQ ID NO: 599 - DNA, 2660 bp, Homo sapiens
gggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttgactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcctgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttactttttttttttcagacagagtctcgctctgttgcccaggctggagtgcagtggtgtagtcttggctcactgcggcctctgcctcctgggttcaggcggtcctcctgcctcggcctcctgagtggctgggattgcaggtgcctgccaccatacctggctaatttttgtatttttagtagagacggggtttcaccacattggtcaggctgatctcgaactcctgactttaggtgatccacacgcctcagacttcccaaagtgctgagattatagggatgagtcactgtgcacagctactaattggtttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttcaactgtacaacccattgtcttgtgatatattgacctgatctcttaggattagtgaaaatttatgctttattaatatttgattgttattaggaccatctagagatttctgtttatgtgtgtgtatgtgcatctgaagatgtgtattttatttaaattttttgtattaagtg

SEQ ID NO: 600 - DNA, 2141 bp, Homo sapiens
tggaaagagcttcacctggaagtcacagttcaaggcatcacagaattcataccggagaaaaactatatgaatgtagtgaatgtgggaaaggtttcccttataactcagatctcagtttacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaactcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgctgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatg

SEQ ID NO: 601 - DNA, 2683 bp, Homo sapiens
accctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtagattgtaatgaaatacacttcctgttttttaaaagtgtttgcagaaaaatgatttttgaagtttttaaatttcctgataagattttttttatatgagaagaatttgaggaatatttgaagctttacaagatctgatttttttctttctcaatataaagtttccatacaatgagaaagggggagaaaacacacattgaaataagacctccgtctcaaaaaaaaaatcattcaagtttcactgtgcctacagtgaggagctacctccttgtgtcatcagctaatagatctgaaagtgatgccggtgtctctaggaaaggaattgatcatagccaagtgactgacattctctcggtcaggaaaagagcttgcttcacagcctttgaagtatgactgtatgtgtggtccccttgtactttggagacagaaggtactggcagcgagtgtggtggatgggcagaaggtgtagcattcggagattatttctgtatgtaattaagagactttcaagggttagccagacttttttccactcaagtgtggattatctttgctacctgtgttaaagaatatcaggttttgtttcttattgtgatttttgagtctaaatgatccaagatttttaaaatagatacataatgaaatccaggcctctgaaaaattatggcaacattcatttggagtgtggctaaaaactcatactttatccaatttggttgcctctctcagttactgcagtttatagaataattgagcttgaaccatgtgaatgctcagaatgtcaatggtggagtatttattcaagagaaatggctgaatctcgatacg

SEQ ID NO: 602 - DNA, 3151 bp, Homo sapiens
ccattccgagaccccagtaccgcggcgacccctgctccctcgagcacttgttgtgtgcactttagttatcaaaacagtctatgtggaaatccagtcccgctcttcattcggagagtccgcgattcctagagcctcagacttcgtcatcccggtctgcgtgactttatgggattctgagtttctgttcccagcacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcgtccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcggtccgaagcaggagtgtcaataaacctgtcttcagtgcg

SEQ ID NO: 603 - DNA, 3639 bp, Homo sapiens
ttattatccctcgccaacaaggcaaggtgggaagttggaaagagggagcaggagaaggatggatttaagattctgaaaaccaaaggaggaatgtctcctagtaaatgtgtaaaggcgtactgaccacccacaatgtggtgtccatcctgttggagttgtatgatcttatttccccttattttggctagtttggctgggagccccatgtggtggaggaccatgaaggacagagccttgatggccttgtgctttgggtattttactttgggcagggcacagtgccaagggccttgcttatttcagctctcctcactggcacactctgagcagggactctgctcattcccatgcagcagatgaggaaacagcctgatagatattaagtaatttgcccaaaggacacagctgatggtgataggatctaggattttgtcccagctctatcagaatccatattcttaaccattgtattgtagcattttcttgggagttgaaaagggattcgatttgtactctaaagggtagaatttaaaaccagtgagaggaaatgagagaaaggcacattgtttctcagcataagaaagaactttgccacagtgggagtcgtgctcagggttccaacttgggtgaggatttgaatttgattagaatcgtgattttaatcaacattgtttacatcagaactaggggtctggaccctgcggctaaaattcttgagttgagcggttccgaccttcaggttttcttcatttgttttttctggagaaatgtaattcctttcacttttgcttggctttctgtaagttactttttcatggggtaagggtgagagtggagtggacgaaataactccttgaacccagcctggggaagcctccaggcagcttgggcccggtggccctttccttgactccacagcaccccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacaggtgattgcagaggctgttctaatcatccacggagtggaatttggttgtttagaatgtatacgatagtgtcatcttcctgcccattgctgagacttgcctagcgcagctgcctcttctctgcacccacatctggaggtgctggtgcagggcactgctcccgagtcaggcctgttctcaccaccatcccaaggagacaggttgaggttatgcagcggatactggggcaagatccctcccaggtccatccagggccatatccatagtagttaactcaggctagttttgagaagccactagtttgcttcttttcccacccactgcttccaagtttaattactaagtggtggtctcagaaaccctggttttcatcattactcacaccatccccttcttttgctttttcaaattacagccccagtttgcaaatggggaagctctgggaccagtgggttgaccgtggttatctaatctccccaccccaggtttggaaaaaagaaacaaaaattgctttttaatttgtagtaataatgaatattagccctggagagatttcctgcctgagagggttactaaacctaaaagtgggtgacagacggaagttgtggctttgtcctctgactcggactagacacttcagggctgaggtggcctagatgggatcactggagctctttttaaaggcactgatattatgcatttacagggtacgtccaacaccaagtgggccaagtgaatcagggtcgctgggcattagacccagaaatctgtgttctggaagcatcccaggtgtttctcaggagtttgagaagccctcagtctccttccacttccgagattagggtctgtgaaggttgtgtctggtctgaatgtccactgcccactccaccctctacttaccccactgtgccctgattagccagcagggggagcccaaaggaagccagctcttaaaatctgctcttggaaacagaatttgttaaattggggataaactcaaaccttccttttctcctacagtgtgtgaggaagtgcactggcctcatgcgcagttctctgtgtgagatctgtagggagagaggagcagacagacagcatcccagccctgtggttctcccagcagggccttgctctgctagacccatctttatctgcgtgagcccctcccggaagcccagctctggtcttctgtggggccgtgggtcccagggctgcctcctacccaggaatacagctagaacatgtctttttggactgactttcaggagacacagggtggaacagcctagcctttaaataaacacctcttacacacatgtaaacacacacactggctcacccaccagctgcctctgggccctgttcttagggaaatggctgtttcccaggcagaccccatcagtcagtcttcaggtacagccggagagaacacttgctgtatctaaagcccctgctggacaatggggaaagaacatccagaagacacaggaagtgttctgacttcagagcacttaactgttttgctaaaccaacccatatcatagtgtgacagaaagctggggtcttaagacacattggggtgggtgggggttgggtgggtggctgtatgtctgagtacctaaggtgataggcctaattgctgccttcataaatgggacatttacttcacaagctgttttcccagggtcttcctctgggtatgtctgaaatataaaaatctggactgggattgaagattgtgtttacaaatgcttttgaataggatttctcctgcagttgttacgtagcttttcagaaacacacagactacaaataatgaacaacatctgcaatgattcggcagggtggcagcatccacgctctccacccaaaccctggtgggatttggagaggccgctggtgggcagaggttggccctaagcatggcagcctccggcttactgcacccagcctgtggggcggctcagtagccgctgacatggtggcctgttgtctcttctcttgttctagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 604 - DNA, 3898 bp, Homo sapiens
ctgttccagacttctcagggtttttacagcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagtggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcaggagaaaaatctattacctgccccgccgttacaagttcatgagcaggatcgataaacaaataagcaggcttcggagatggttacctaagaagccaatgaggctggacaaggagacactgccggacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaat

SEQ ID NO: 605 - DNA, 2429 bp, Homo sapiens
tttctcttacaatgtcgctttatacaaaactgtctatttatgtggacttgttagaataatttcatagaagtttcaaaatgtgtatttgctggaccagaactattttttcccttacaccttgaccagcttgcatattggataccacatgattatcaggtataaaataaaatttatgaatgttttcaatactggttttgacattgctctgacaatggaatatatctcgtgtgtgtgtgtgtgtgcatgtgtgtgtgtgtgtgtgagagagagagagagagttaagtctcagctgtctcccgggctggagtgcagtggcaaggtcacagctcactgcagccttgaactcttgggctcagacgatcctcccacctcagcctcctgagtagctgggactgaggtgcaatccaccacgcccagctaattttttgtagagacagttttaccatgttgcccaggctgatctcgaactcctgggctcaagcaattcgcctgcttcagccttccaaaatactgggattacaggtgtaattgggtttttttttaaggctttaaaatttccagaacattttttctcatttcctcctgatcattacaaaaatctttactgaaaggtagggcattgtaagagagttaacttcattttgcagatacactcagaggggttaaaaatttgcaggtacatatgcacatgactattaagtgataaaacaagtctcaaagctgtttttaccctttctttctttttttttgagacagtcttactctgttgcccaggctggagtgcagtggtgagatcatagcttactgcagccttgacctccagggctcaagtgatcctcctgcctcagcttcctacatagctaggactacaggcatgcactaccatgcccagctaagtttatgtgtgtgtgtgtgtgtgtgtgtgtgtgtgtgtattatttatttatttatttttagtaggtggagtctcgctctgtcaccgagcctggaatgcagtggtgagagctcactgcagcctctgcctcccaggttccggtgatcctcctgcctcagcctcctgagtagctgggactatgggtgcgcaccaccaccatgcctggctcttttttttctggagacggagttttgctcttgttgaccaggctggagtgcagtggcgctatctcggctcaccacaacctctgtctcccaggttcaagtggttctcctgccttagtctcccgagtagctaggattacaggcatgcgccaccatgcctggctaattttgtgtttttggtggagacggtttccctgtgttggtcaggctggtctcgaacttccgacttcgggtgatccgcccaccttggcctcccaaagtgttgggattacaggcgtgagccaccgtgcccagcctttttttgtatttttatatttggttaatttctttctaccccatagaataaaactgacataaaacataacaaaaagaaaaaagcataggccaggcatggtggcttatgcctgtaattctagcactttgagaggctgaggtgggcggatcacttgaggtcgggagttcgagaccggcctggccaatatggcaaagccttctctctatactaaaaatacaaaaaaaggcggaggttgcagtgagctaagattgcgccatggcactccagcctgagcaacagcacaagactctgtcttaaaaaaaaaatgtatttatctggaagacaaatgtcaaatcttaatagtggttatccctggattagagcattttggtgtgttgctttcctggtagaatattgttttaatgaaaatggatcaaaggaggacatagatgggtgaaaaccatgaggaattgactttgacattcttaattgcatcagcagaaatggttaaaaagtacttctaaaaccacttgcatgaactaggtgtttaaggggaaccgctcacgcttattctcagatacattaataaaaggacacttgaagtctatgaagaagatagctgttccagccttaccgcacattttcttcctgagtgaaaataggaacttatgtattggtggccatcttgacatgaaactacaagatccttcccaacagtatcatcctacactgaaacctggaaccaaatccattcccattcagcaaatgttgatcaagtggcatgtaggggatacagagatgattgcatacaaagatgaaaaagaaaacgtttctgccagggccaggcgcggtgactcacacctacaattccggcactttgggaggccaaggcaggtaggattgcttgagtttgagttcgagaccagcctgggcaacatagttgaccttatctctacttaaataaaaataatcagccaggcatggtggcatgtgactgtagttccagctactttgggaagctgaggtgccattgcactccagcctggtcagcaagagc

SEQ ID NO: 606 - DNA, 3584 bp, Homo sapiens
gatctgggtggggaggatatgtatgtgcactgcacaatcctttcaactttgctgcaggtttggaagttttcctaacaaaatgttgggggggtggggaataatcccctcaccgtgagccattttaattgaaaccaggctcttgaccagtgtgctccctgaggccagagggtgagggagttgtgtggattggatccatttcacctgtgaaggctccccgtggggagttcctgctgccaaggctcaaaagtggtgctggtcccagactggtggagaggaggggcaggaccgccctctcccttccagggatgagctcatgctgcccattgccccagcctctgctatggaacccttgagctgcgagacactgccctttccagtggcttacccctcacacgcccgcatctacacagttaagactgcattccacagcggactccgggcccgagtctggctttccttccctctcctggagggcttgccatctgcttcagcgctgcctgtgacatgggagggcacctgctcagcacacatttgctgtggctctgagacccctgggtaagcagagaggctgtctgagcacaggagggttgggaggcttggctgtccagatggtccccctgccgcctacaggttctgggcaccagagagtggacggagccaggggaagcaggggcaggaagttaagtggcgggtgaagaggctttctggagttgagttctgacctatattatattgtgggtcacacacattggtcgtccagggaaggtgctgggatccagttaacaagccaggtaactgactcagatgtggaagtaaaatgaaaggtctccccaccctgcctctccagtcacccactagttgatgagtggtgctcagcaaatgaaactcttggttgtattaatatcagccttcacataatggcattagggaaaaaaataatacaaagttgattttttaaaaaataccaattgtagcactgcgttctgcctctgattgtgtcgaaaatggagactccactgtcaggcccttggtccccttggaagacggtgctatctagtcttttcacagtccagcacgctcacactccagaacaaacactcacactccaacacaccctcacacacacactccaacacacacagatgctcgcactcacacacatcctccctcacacttgcactccaacacacatacactcacacttgtacacactcatgcacacttgcacccactcacaaacatacacttaaatacttcctcacacacacttgcactcacacactcatacacactcacactcgctttctcacaagcacacacattcctctgagctgagtgatattcctgcccctcacacctgctgagtgggggcagcccccgcctctccacccttgcaggcgatggagaggaccccctgcaaggaagggccagggcatccccctgcaggttctagtcctggctgcctgtgctcataggaggcagtagactttggcactgagatcgtggactctggagccagactctctgggtttgagtcctggctctgctgccactagctgtgtgaccatcaaccattgcttcacctttctgggtcttggtttcaccccttatataacaaggacaataatgcctgccccataagtcactgtgcggattcatcccatttctacgtgtaaggtgctcatataggaagcactggtgagtgttagctgctgctgctgctgctgctgttctcagcatctgctcctaaatcatccatttctgggtttcgggtccctgggcaggaattcagcttctaactaggactcagggagaacaaccgtgttttctgctatggctgtaacagatgaccgcagatttagtgacataaagcaacacggatttattttcttacagctctggaggtcagaagcctgaaatcattttcactgggctaacatggaggtgtcggcagggctgcattccctctgaggctcccagggagcatcggcttcctggcctttccagcctccagagctgcattcctcgcattccttggctcttggcatcctccccatcttcagagcagcagccagcatcctggcttctgttgtcccactgccaccttcctctgtagtccagtctcccttgctccctctcagaaaaaccttggtgattacatttagggcccacagagacaatccaggagaatccctcatctcaaaatccttaacttaatctcatctgtgaaagctcttttgctgtagaaagtaacagtgatactctggggattggagtgggaacatatttgggggccattattcacacaactgaagcaggaggaagcttccctgggtcctggccctgtggcccaacttggccaagttctggaccaacttggagcaccagtctagacccaacccagccacacccgctgccagggtcccctgctgtcccttcatgctggctctaggccctctgtctatctccccaaacaggctctgagggcagagttggtgttccattctctgctgaatcccagtcctggcatgtggggcaccagatggttatgtgctcatgtgtaaaggtgagcaggtgctgatgtgccacatgtatccttttaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagaggtactggttccactgacagccccaccttacttctcacccaggccaggcctgtggtccagccaggcagccctcagggccggctagcctccactcctcacctcctgcatctcccacccagcaagcctcgctggggagccgcattcttaccaaccgtaactgaaactgtggctttcaaatgctggttccataagggttttgtaagaaaacaaaaacagaacaagaaatacaaaactgctactctgttcctaaacacgtttagaaatcacgaaatcacagagttaaatgaaattaaattggtgttggtaccaaaaatagcaccttctcagagccttgagtgtactattgtgtgctttcacaggagaatacagtgtgcatcttttttcaaatgaattaaatcccccacactgatatctcccaaacagtgtttcacagaacccttatgggaaatgctgacaaacatcatcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtctc

SEQ ID NO: 607 - DNA, 2458 bp, Homo sapiens
agtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgccgcccccccagcccgccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaag

SEQ ID NO: 608 - DNA, 2690 bp, Homo sapiens
acgtgacctttgctcatggcggcggcggcggcggcggcggtgctggtggtgctcggcggccggagccggatcctgtagccgggtgtgggcccgtgtctgtccgtccctccttcggccccctctcttgtcttccggagtgtggctggcggagctgggatggcggaacgaggcctggagccgtcgccggccgcggtggcggcgctgccgcctgaagtgcgggcgcagctggcggagctggagctggagctctcggagggggacatcacccagaagggctatgaaaagaaaaggtccaaactcctatctccttacagcccgcagacacaagaaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatctctctgctcctcctgatgtcactacaactacctcttcctcctcatcatcttcctcaattcgcccagcaaacattgacctgccccccccggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactccgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggtgagtctgcaagattccagatccttctctcctgagagttcttcagaatatcatgggtagtgtttttatctagatacttagcagttgctggccattatgtttcagtagattttttcaataatttaaaaggatcctaagctctaagtaaagctattgccaaatattttcatttgctaaagcaacatttgcaagccagctaatatttaaaagacagcaaaaagaagagagactttgtacatccatagatgttttaacattacaagaggattttagaaaaacatttggtattgatgtatggtgaaaatcagatggttttatctaacagttgaaactgattacttgttaaatctttattccatcctgcttcttgattataataggcacaaaattctgtaatgaacaaagaatgagtacttttccgtttaattttgcatactagctaaaatttttctttttaaaataacttcaaggaaaaatggggtcaaccctgggctatgagattttgtactagtttattcaaacagattccttttctcctttgcaagtggagcacagtgtccatagacctagatggaaaataatctttgaggaaaaacaaggttttatttaaagaattacgcaggttgacatagtttaaactttggatgcccctctgaataaattgtatgtaaaataacgtagctatttaaaataacatgatttcccttatctcataatctaaaataagaatttctaagagtggttgagggaagggagtaggaaaagaaaagcattttttgtttgtttttgtcaaaattgttttaacattcacctcagaagctgtatatacatttcattcatataacccttaaagaaagcatttaactggccaaatctttgcatgtttatttaacatctatgaatacatccatatgttcatacagataatttccattttaatgtttgtttttactaaattacagcagtatggaatgtttaatcatttgagtcatgtttttgctttgcagtttcctcaagtgtctgataccacctatgtaagtggtttttcagaaaaagcttacaacatttctgaagatatttgtaaattttttaaaaaactggccgggcacagttggctcatgcctgtgatcccaacactttgggaggctgagacaggtggatcacctgaggccgggaatttgagaccagcccggacaacatggcgaaacctcatctctattaaaaatacaaaaattagccggatgtggtgacacacacctgtagtcccagctacttgagaggctgaggcaagaattactcaaacagggagacagacagaggttgcagtgagccgagattgcaccactgcactccagcctgggcgacagagtgagactctgtcttaaaaaaaaaaaaaaaaaaaaaaaaaaaaaaaaaaaag

SEQ ID NO: 609 - DNA, 2942 bp, Homo sapiens
gagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgccgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatgg

SEQ ID NO: 610 - DNA, 2863 bp, Homo sapiens
gaggacctgctggagcaggggtacgccacggccctctcagggcacccactgcgcttcagcgagagggagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgagggtatgacaagcacgggcctgggagctggaagacaggcaggtgggggcctgggatcctcccttcccgcctggcctagctgtttatgagagcctttcctcagagaaatgtcaccgccgccgcccagggcttcggttacaagatcttcagcggcctcctgaaggtggccggcctcctgcccctgcttcgagaggcatcccataggcccttcacaatgctgtggcccacagacgccgcctttcgagctctgcctccggatcgccaggcctggctgtaccatgaggaccaccgtgacaagctagcagccattctgcggggccacatgattcgcaatgtcgaggtgggtgcagcccccaaccttggtcctcactgcctgcagctcagcctgcctttccacctccaaccatgactccacttgctcaggccttggcatctgacctgcccaacttgggcccacttcgaaccatgcatgggacccccatctctttctcctgcagccgaacgcggcccggtgagctcatggtgggtgaggatgatgctcgcattgtgcagcggcacttgccctttgagggtggcctggcctatggcatcgaccagctgctggagccacctggccttggtgctcgctgtgaccactttgagacccggcccctgcgactgaacacctgcagcatctgtgggctggagccaccctgtcctgaggggtcacaggagcaggtacagggctaggggctgagtgggggtggtggggtgggggcaggcagagcccaaggaccaccaaactcagaaccacccaactgcggcctgactcctttggcccagggcagccctgaggcctgctggcgcttctacccgaagttctggacgtcccctccgctgcactctttgggattacgcagcgtctgggtccaccccagcctttggggtaggccccaaggcctgggcaggggctgccaccgcaattgtgtcaccaccacctggaagcccagctgctgccctggtcactatggcagtgagtgccaagcttgccctggcggccccagcagcccttgtagtgaccgtggcgtgtgcatggacggcatgagtggcagtgggcagtgtctgtgccgttcaggttttgctgggacagcctgtgaactctgtgctcctggtgcctttgggccccattgtcaagcctgccgctgcactgtgcatggccgctgtgatgagggccttgggggctctggctcctgcttctgtgatgaaggctggactgggccacgctgtgaggtgcaactggagctgcagcctgtgtgtaccccaccctgtgcacccgaggctgtgtgccgtgcaggcaacagctgtgagtgcagcctgggctatgaaggggatggccgcgtgtgtacagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccgtgtgcactgacctgcacttccaggagaaacgggctggcgttttccacctccaggccaccagcggcccttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcgtagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctggcacccccacagcccgcagtgctggcttctctgccttccaggcggaagatgatgctgacgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcacc

SEQ ID NO: 611 - DNA, 3533 bp, Homo sapiens
atataattttttaaccaaagtgcagtctttaccctgtcagggccctgccttcacctctgccaggactatcttccatgtcaagtttagacccgtgtcattttcaaagctaataatggttcccccatactttaggcagcatttagatatttggatttgggatggccttttatgttttaactacagtgttagaaatcagagcccttggaaccactgggatcagagggcagcagcagaaggcgcccttggtcctctttgaggggcccagggctccggagagggcccccgttcctagcagccacagtggcctgttggcacgcatgtgtgtgttccagctgctctgtgacatttccctttgtttcagactcttgaaaggccacggccgtcgtgggaattagttgaccttgtgtgttgggccacccttgctggacaggacaaggtggtgctatcaactccctgtgctctgaggtccttcgcatgctagatgaggcagcttcaccagaaactatccatgtctcttctgttatctgggataattccacgtgcctttacaacacagctgtctggttacctggggtctggaaatgccctcggtgcctcagtggtgccttcccacaggccccccatggagccaggcgatgcctacagatgcctcagtggtactttctcaggtccctttgcagagaagaggttcaggattcctgcccacattgataaggcggcttggccagtaagtggcaggcatgaacaggtgcattccagaagcgctggggctggtccagtgccctgagtggtctagagcataccagagtgaaacgttaggctgcgtcggcctggtgactgtcagggagatgaggactcagagaagggagctgtcagaattgctacctatgtggcaggggtctcactctctcctccctcctcttggggcccctggctactctgtgacttcaacagaggacagaaaggatgaccaacaaggcctcagggcatacccccagctgcactgtccttgtccccagaagggtccccagagtctgggagggaggaggggccatggccaggattagaaaagaccgtgccccaaggagagagcacagagatgggccggggaagcagtgggatcctcgggaaaagaggctgggagcaggtgtccgggtgaggcccgggcagcgggtacaggcagggacaagccaggagtcccatcatggaagacatgatggccagcggccagcactgtgtgcagagaatggcccctctggggatgtgcccgctgccccattagttgcaggaaggccacctggatgtgagtttgggagatgggctggccccgaggcagccagccctgaggtcagagtgagccacatgcatggggatgccgggaggacacagaggagtgctgcaggagatggcagtgggggcactttccaggatgggcccgagcaactcagtcactgggtggatgtctcaccacccctccaggccttcctcagggcgaggccactgcccagagggcacctggtttgtcgcagagtagaatcagctccatattttgtaatcacatccacgaagctctgaagccatggtggtcctggcaccagctggctccgttagaggcttggggtgggagtgagcaggtgggaggtgccccagtgacaggctgagtgctggagcccaggctgccaacagcctccccagactcctgagttgatgtaataaacccagccctggtgaataaacctggcccttgcttataccaaggtgatcagtcttctcacgacagtcctagctgtaggagaaagatcattacctacggcatctgccacagcagttaatttgccttcaacttaagctagttgcagtgacaggaagggccagggggaaatatctgtcctcaggacctctaccctagatccttgtaagccacaacaacttcccttctttgagggcgcgaccagtgtcacctggctcgccactgggaagagccaaggcacatccaggttggtggctgctgagccccacagcatcagaccagcctcttgtccccaccccacagaggccaagggggtgatctgggagtagcaccccagcctggccgctctcttgaggtaacagggttggatggttagggagcttggagcactggcccaagcaagaaaacagtggtgttttcaggaggccctgctgggagatggaagacagctccccactgggggcctaggattccaggagctccccagcagtcctccgtgggacatacgtgggtttgcacctgctgccctgtcccgctgagggtgcggtgctgatggggtggccctgcacactgatggtaactctcactttccctctctctcatgcattcagaaagagatggatagtttaaaaacgaatacatggaacgtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 612 - DNA, 2598 bp, Homo sapiens
gacccagcgccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgccctgtgctgtgccaccaacgaggacagatcctgggtgttcgacagctacagcctgacagggccctccgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccactgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggggccttgaggggagggcccagccggcgggagctggctcagaactttggccaaaggtgaacggaattttttaggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttcctgcccacctccccgtctcagccacagccgttcccaagcaccagcgtggctcctggtgccagtgacctgccaggaggccccttgtgattataaaaccgttcagttgggccgggcgcagtggctcacgcctgtaaccccggcactttgggaggccgaggcgggcggatcgcggggtcaggaggtcgagaccatcctggctaacatggtgaaaccccatctctactaaaaaacaaaaatacaaaaagttagcctggcatggtggtgggtgtgtgtggtcccagctacttgggaggctgaggcaggagaatcgcttgaacccgggaggcggaggttgcggtgagctgacatcgtgccactgcactctagtctgggtgacagagcgggactccatctcaaaaaaaaaaagaaggaaaatattgtaagcctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgc

SEQ ID NO: 613 - DNA, 2506 bp, Homo sapiens
atttcgagtaggtcactaattatcaccgggctctgaacctgagaattagttctaggaatattccagacctgatccagctccagaaacttacccactttggaactgaacatgagcccaagaatgctctagaaacaaatgctaactctagaatggattgtctgctccaaaaaaaccctagagctgactcccagttctccccatagagccgagaatgaaatacaccaccagctcccaacacactgtaaacctgagccccccttcccaacccagcaattgaaaaatgtgaaccagctcctaagcactagaattgaccactagttcctggagttggctactggttccttatcactgtttttctttctttctttctttttttttttgagatggagtcttgctctgtctcccgggctggagtgcagtggcgcgatctcggctcactgcagcctctgcctcccgagttcaagcaattctcctgtgtcagcctcccaagtagctgggattacaggcacatgccactatgcccggctaatttttgtatttttagtaggtctgatcctgttggccaggctggtcttcaggtgatccacctgccttggccttccaaagtgttgggattacaggcgtgagccaccgtgcttggcctccttaagcactctgaaccaagtattgtttccagcctaatacattgtggaacaagtggcaatttctatatgaacctcaggaacaacgaactactttccagcaccttctgagtctgattttccagtttgtaagccagtatggtccagataagcgtgaaacccaacccattctagaacagttactagccctttttctggtctctggcactgcagggcctggagcatagtttattttttgaggtggagtctcgctctgtcgcccaggctggagtacagtagtgtgatctcggctcactgcaacatctgcctcctgggttcaagggattcttgtgtctcagcctcgtgagtagctggaattacagatgtctgccaccatgctgggcaaatttttttttttttttctaagacggagtctctgtcgcccaggctggagtgcagtggcgtgatctcggctcactgcaagctccgcctcccgggttcacgccattctcctgcctcagcctcccaagtagctgggactacaagcgcctgccaccacgcctggctaattttttgtattttttagtagagacggggtttcaccgtgttagccaggctggttttgaactcttgacctcaggtgatccgcctgcttcggcctcccgaagtgctgggattataggcgtgagccactgcgcctggccatactttttactcccctctaaccttcagcaccagttcccattccatgttgatctagaacagagtatcccatcccaacacactgtggacccaagtaccagctcccagtgtgccttgtgccagaaaactagttttcaaatgcgttaaactcaagttccatttcctaaaattctttaccagagcagaatgaggtcatgttcaatgtgaattgggacgtgccaatttgaagtaatgcagaaacgatatcttgccttatgtgcaggtctgaaacaaagcaaatccctctaacataaaggaaaagaaaaatggaattgcctaattccaaagctgcatcagctgaatgcattgtggactgttgctgttgagcgtggggtggggtgccaccatgcaggctttgaattcttttttttttttgagacagagtctcgctctgtcacccaggctggagtgcagtggcgcgatctcagctcactacaacctccacctcccaggctcaagcgattctcctgccacagcctcccaagtagctgggactacagttgtgcaccatcacgcccagctaatttttctagtttttgtagagatgggtttttttcaccatgttgcccagaccggtctcaaactcttgggctcaagtgatccgcccgcctcagcctcacaaagtgctgggattacagacgtgagccaccacacccggctatctctcttccttttaacatgggccccacgcctggcctctgttcctgcaaactgactccctaccccaaccacctctttttctctccacagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccg

SEQ ID NO: 614 - DNA, 2909 bp, Homo sapiens
gacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgctcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacatatctatgaaagctggtattatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaggctcgagactgtgagttttctcccttgaaactcacctggagagagtccgggcacctgtgcctatgtggagggttccagccccagccaggcccctccactgcccacaccctgggaggagaagcggcctcccttccaggctcatctgctcactgcccgcattctcctggcagagctgaggtctgagagatctggactccaacccaagggccctctcttgttattcaggggtgtccacagttagggagggacctggggccttgtcccaccaccttcctaggccccgtgatcaccaccccctcaagcggggccccagccccctgagcaccccctcacgtgacccagccctcggctgttccaggctcactgcccatggtgtgctcttctgggtcacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcggaacggggagtcccctgggatggagctgctcccctcacggcagcaccacgtttcccgtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaaccccctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaatacaactttggcttgtt

SEQ ID NO: 615 - DNA, 2951 bp, Homo sapiens
aatcccagcactttgggaggccaaggcgggtggatcacctgaggtcaggagttggagaccagcctggccaacatggtgaaaccctgtctccactggaaatacaaaagttagccgggcgtggtggtgggcacctgtaatcccagctactcaggaggctgtagcgggagaaccgcttgaacccaggaggcggaagttgcggtgatccgagatcatgcgactgcactccagcctgggcaagagtgagactctatctcaatatttttttaaaaagaaaattttggaggagtgcacagatcatgtatcaagaccttatgggtggggcctttgtaaggactttggcttttattccgagaagctattgcacattggagagctttttcgtgggtttttgccagggtgtctttaccctttctggcttactatgacttgtaaacttctgtatgtgtctagtccatactgctttttgggctttctaagttttctatttaaagtattagcacaggatttccttcgacttgaaccacacaaagctcgcaggaacactgcaggtgttagtgtctcatggctgctcatatcctcacaagctttcatcttgaaacatggagcagcattcatcccttcagttcccagctgcttatcctctagcactctcctcagggctttgtccagctttgtttacctctgggtgcgtgttggctgcagcgtacccagaatgggtgtgagggcaaaaagggtattctcacttccttcccttcctgccggagccaaacatgttctagccttgggccactctaacttgttggaccagtgttttcagagaacaatctgcagggaatcttagggccctctctggagttatgactaagagtagaagttatgaatagtccatcccctagaaaataggttagatttccttgccccaagctgatgacctaataaatgcatgacaacatagagacacgtccatgaagtgtgcccacctctctagcccacctgtgttattcagggttctccagagaaacagaaccaatagggtgtttaagacagagatttatttgaagaaattggggccaggcatggtggctcacacctgtaatctcagcactttggggggccaaggcaggaggatcacttgggccctgcctgggcaacagaggaggaccccatctctacaaaaaaaaaattttaaattagccaggcgtggtggtacacacctgtggtcccacttaggaggccaagatggaggatcgcttgaggccaggagattgagactagcctgggcagcatagcaagaccccacctctacaaaaaagaaaaaaaaattagttcgtgcagttgtaaggcagagaagtccaaaatcctcagggcaggcggacatgctggagattcccccttgaaactttgagatttcctgttgtgtcctgttgttaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacgtgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcggcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaatagg

SEQ ID NO: 616 - DNA, 2379 bp, Homo sapiens
caagtgtcttccttgcaaacccccaaggactcaatgtgtgtcgcccttgactgatccccccgccccgtgacccagtggtcctcagttccaggttttcccacctacccttcacccactgcttatgtttataaaaacggggtaaatcaaatgttcgtgacccagatcttattctacatgcagtggaaacttgtatgacttaagctttttggaaaagcagaaccttttttcgtggttcaagaaatcaaagtcttcccgggaggtctttctgtaaatccagagctgcagatgtttgaccgtgttcagagaggggcccttgtgctgggtgaagtggatggggcacagcaggcaatgggtgaaaagcaggacaacctggggccctgggaggaccagggagggcccatgtctttgactgttcatcagccggctgacttcctgtccgcctgtcgtctgctctgcccatccatccgtagtccttccgcctgtctctgctggttgccgctgtgctactcagctgtgtctgtctgtccgcctgactgtctgctctccttcaggatgccttccgtgccttccatcaagatctcaattttgtgcgctagttcctacagcccctgttgattggggagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccagtgagtcctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgt

SEQ ID NO: 617 - DNA, 2605 bp, Homo sapiens
tgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcggagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaagagatagtccactgcgttagtgacaagtggttcttgtctgtctcccccctcctgtccccgcgccttccgctctgcctcctccccctgtcgctgggaacccccttcgccgggtaggagagcgctgctctggctgataggttaatccaggtactgtagctttttatcccctctccggattccttcctggccccttccctgcaccctgcacatgacagccagtaaccgcctcttccctgccattctgcgggcaggcctggcgccatgcatggagcagctggggaccgcttctgggggacacagaggcttcccgggggggcggggcatgtgaagtggggagaagggtgtgtgtggaggggctgtgagtgcgtttgggtgtgaatgtccacatgcatgtacagaaagcttcctccgggcgacacagggtggggacccaggagggctggggaacctaaaaccatattcacataaggccctggtgtgtgcagtgctgcggtcacacacacacacaacacatgcacacacacacacgcacacacacgcccggccctcacgctgctgctctctgctcctacctgcaatgcctgctaccaccttctctagctcacctgctcctgctgccacctcatcttgaatggctttatctggaagctgccacccgccacctggtggctttgagcctggaatggggggcccaagttgggtaggggacaaagatgaggtgggggaaaaaagggggtcttagctccaggcaggtggaggccccagagcccaggactagagaagatgccgctgggagaagtgaatgcccccggggagcccagccctctcctgccggggcctcagctgtccccagatcctcaccctcaccggcagagtctggcatgaataggcacaggtggcctcgctgtgcccctggataaggatcccaactggggcagagactgagagccagagtggggaaggagatggagctttccaagcccagggctagctctgttcctcccgggctcctccaggtgtcctattcctgcctgtcacccacccacgtccccaggcccagtgggacgctcatcccaggctctgagtacgggaggcccccacctcacttccccccacctccactctctgggcctccccctgtggcgggaggcagggccttgggtgggagccgagggtcacggcctccccctgccccctgtcctcgctgttctcaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggtaggggcgggtgtgcggggctgctgggcggggccatgacccgcgcccccgcccccgcccaacggttttctttcagggctcataatctgccccgcctcagcacctggccctcctgttcctttctggggtaaggggaacccagagacaagcgcagattctcccccagcagctccacattctgagacatcctgatatccatttcttgccacctcatagtgtgtctgcagtatctgacttcccaacccccagcctcagcacggaggcctctgaagaccgggctgtccctgcagggtttcctctgtgtcacaggcagcagacagggctgtgactccttacggaggctcttgcctgtccccagggtctgaaggattgttaggtgtccctggggggccagccatggagaatgggagcagggcagtccgggactgtttggggagctctgagccagcagggtggggctgagggggcaccttgagtgtcttgagggccatgaactttgggtcccatgatgggcaggcccatgagtggggccccaccccaagattttcttctcctgaaagcttttagaacttaactgcgacctggtgcagtggctcacgccttaatctcagcactttgggaggctgaggcaggtggatcacctgaggttgggagttcgagaccagcctggccaacatgatgaagccccatctctaataaaaatacaaaaataagctgggtatggtggtgcgcacctgtagtcccagctactcaggaggctgaggcaggagaatcacttgaacccgggaggtggaggttgcagtgagccaagatggcaccaccgcactccagcctgggtgacagagcaagactccatctc

SEQ ID NO: 618 - DNA, 2136 bp, Homo sapiens
caaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcactgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 619 - DNA, 2300 bp, Homo sapiens
aaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaaggtgctgaggagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccatgctctgcgtaagttccacatcaccaaccatgcatgcttggtgctggcccggggagggcaccccagcctgccgttgatggcatggatgtcctccatgaccacccaagtctgctgcagcccaggcctggcatcccctctcgcctcagcccctccccagaggccaccctctggccccgaggggagagtgtggcaggcacaggcagtgcagatgttggtctctgtctcccactttctcccccttcctccgtctctctctcatggcagttttcacacagcatggggcatcttatacgtccactcttgcccttccttttctaacctcattccacggggatcccttcatgtctgtgtggacagcaaccttgttcccacagctgcatggcgctcctaggcggtcccagctggaattacccaaccccatgacggaccctttcattgcagcgatctgcacacgtgtgggtgtttccataggacagtgtcaggcacggatggctggtccgaagcacgtgcatttcagttttgaggctcctgtcctcaggcagtgtggactcaggccctgggagtcatgtggatgccagtagcctgggcccacagagctgctgggatgtggggggcatatcaagttgaagatggcaactctgatctgacgcctctgtgctcagggcccctggaggaggggctactgccccttggcccttagacaacaggacagagaccagagggactgggcggcttgtcccaggctactgggctgtggtctctgaccccctggaggcctccccacgcctcacagaacacagtgcagacggtgggcggggagagctcgaggggaggcccagccctgcaggtgggactggctctccctccccagccacgagtatgccacagggggctttcaaaaccaggcagggccaagccttggccccactggaggtagagcaccttctgtggctcccgggtgcctttaggcccgtccaggagttggagcagaggagaagacccagactgtgcatagttccctgaggagggctagcctcaggtgccacagcctggttcggcctggcggccccaggacgcagcagcaaccttgggcttcctgcggggtgactaccttgccctccggccctgcccgttgactaactatgctctgtggttttgtttccagagaactcagattgcacagagctagactcgggcagccagagcggcgagctgagtaacaggggtaacacctccctgctgcccctccctctctctccctctctctccctctctctttaccctccccagggctccatctccgcctcaggggcttctccaccccaagtctggctccattcctggccttctgttggtgacagacccccccctaaggtgctcgtttgggggctcttcaggcagcacctcagcctggcacccccactcccctgcgcagcccccaggcctcaggaccccacccctctgaggcccaggggagccctgttcacgctggtttctccccaggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcctgccaaggggactgctgcttctttttctaaatgcatatttttcattatttataatttgtgtaaaaaacacaccttcaccttacaaggtgctgaccatattaaatgttcaagttctc

SEQ ID NO: 620 - DNA, 2381 bp, Homo sapiens
agcttggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggtaaggatgggctcctcttgaaaatagaacgtacctattggatgaaaacctttgtttctaaattaagtgctttgtttgggctttcggttctgtattagaggttttgtgtttccttctgaacacccagtcaggattgctatgctcttttctgctctgttctttctactctactctgctttctttagaaggcccgaataccaaagaaccatatttaaattcttgggatggctctgtgacctcagcatatacagtcttttcttccccataagcaggatatcagctttccaaacctggcgtgatttcccagttggagaaaggagaagaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggc

SEQ ID NO: 621 - DNA, 3172 bp, Homo sapiens
tattttgttttgttttgtttttgagacagagtcttactctgtcacccaggctgaagtgcagtggcatgataagagctcactgcagccttgaactcctgggcttaggtgattcttcaacctcccaagtagctgggactgcaggcatgcaccaccaagcccagctaattttctttttttgtagaggtgtggtctcactatgtcatccaggctgcttttgaactcctggcctcaaacaatcctcctgccttggcctcccaaagcactgacattacaggtgtgaaccaccgcccccagccaagtcttctctctctttttttgcccaccgtggtcaacctagctaaaggtttgtcaattttgttgatgttttcgaagagccagtttttggtttcattaattttctctattctttttctattctctatttcattaacctttactgtaatatttattatttctttctgttctttctggtttagtttgctctttttccattgtcttaacatggaaggttaggttaaggttattgatttgagatcttctttcttaatataggcattcacacatattacatttatacttctaggcatgtcttttctttttttgacatggggtctcactccatcgcccaggctggagtgcagtggtgtgatagctcactgcaacctccgcctcccaggctcaagtgatcctcccacctcagcctcctgagtagctgggaacacaggcgccagctaattttttctgtttttagtagagatggggtttcaccatgttgcacaggctggtctcgaactcctgtgctcaagcaatctgcctgtctcagcctcccaaagtgctgggattacgggcgtgagccaccgggcctggcctggcctttacctgtgtctcataagttttttggttttttttttttttctgagagggagtcttgctctgtcgcccaggctggagtgcagtggcacgatctcggcttactgcaagctccgcctcccgggttcacgccattctcctggctcagcctcccgagtagctgggactacaggcgcctgccaccacgcccggctaattttttgtatttttagtggagatggggtttcactgtgttagccaggatggtctccatctcctgaccttgtgatctgcctgcctcggcctcccaaagtgctgggattacaggcgtgagccaccgtgcccggccataagttttgatatgttgtgtctttattcctgtttatctcagagtattttctgatttctcttttgatttattatttgagacgttggctatttaggagtgtgttgtttactttctacatatttgtgaatttccaaagttttttttttctgctattgacttctaatttcattccattgtggttggaaaacatacattgtatgacttctatcctttcaattttattgaggttttcttttttttttgagacggagtctcgctctgtcgcccaggctggagtgcagtggtactgtctgctcactgcgagctctgcctccgatgttcacgccattctcctgcctcagcctcccaggtaggtgggactacaggcgtccaccaccgtgcccggctaattttttgtattttttggtggagacggggtttcatcatgtttgccaggatggtctcgatctcctgacctcatgatccaccccccttggcttcccaaactgctgggattgcaggcatgagccaccgcgcccggacttattgaggttttcttaatggcctagtgtatggccttgaagagtgttccgtgtgcgtgtgagaagcgtgtgtgtggttgttattgggtagagtgttctagcctgcttatgaagtccagctgtagtgttgttcttatcttctggttctttgttgatcttctagttgttctatcccttattgaaagtggggtactggggtctccaactgacatacttttcttttagctttttattttggaaaatttcaaacatatatgaaagaagagataatgtacttactcatcacccagcttcaacatttatcaacatcttgccaatcttactgaatctatccttccttaccttttttaaaaatgtttcctagagtgtgtcaaagctcatcccagatgtcctaatgtttctagtaaatgcttctgcacaattctaaaagacaaggatgtttttaaacccagccccgacactatcatacctcacaagattcatgctaattcctcagtgtcttctagtcccaagtccatgctcaagtgtccccccctgtccaggcaccctcttcaggggtcctccatgtttcatagcgagaaggggccctgagagttgggcaccccgggcaggctggctggagggggctttggaaaggaaggctttggccagcgtgtgagggtgcaggtctcaccagctcctgtttggtctgtttcaggaacaaatgtggtatctggggctggcggtctgagaagatggaaactgttagcggctacgaggccaaggcaggagaggctaggggtggggggctgggggtaggagatgaggtccaggaactcagctcctctccacatccatcccagagtagcccctgggctctggaaaccctgagcatttgtgggaactcagcgggcctgagtgcccagcccctgcggagtacacagggctcacccacatcatgggcccctacccagggtaccgagatcaaaagaggagtgtgttcctcttgaccctggggctgcatctcctcgttggtgacttcctggggttcagaccctgccacctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaattcatttatttataaactctctgctgctgagcttggggcctggagccccaggaatgagcaggcaggggagactgagatggaaataaagagactgtcgcagc

SEQ ID NO: 622 - DNA, 3078 bp, Homo sapiens
gtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcacaacacctcaaacttttctaaacataaaccatattggtgccctagaaatgtgaggaatatgacaaggactttaaatggttgtcacgcttgattgtaggtaaggtaatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcgaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtacttt

SEQ ID NO: 623 - DNA, 2267 bp, Homo sapiens
agatcagctgatgggggaggcggctccgcagccgcctagaggccccagccgccgagcgcttcgtcccggccctaagtctcggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgaggtgagagtgagctggggggaagaggagcggcaggccctgcttgggcctcgctcgggagctgtccgggaccaggagctgtccccgaccaagagctctcttcaaccaggggaagaaaggggagctgtccccggccgggagctgtccccgactgggagctgtcccaagcttagaacagacttcagaactcgcttttccggccttcctggggtgggctggcttctccacacctgtgtgtgtgtgggtgtgtgtgtgtgtgtgtgcgcgcgcgcgcgtgcgcgcgctgtgacagggagatcctgtggacagaaagtaaatctttcgtcactcctttgccttagagaggggataagggagaagaatcttgtctttgacttgggaatacttaagtgagttcagtctgaggcataccggaaagtagaggaagagaatgtgggtagggggctgattgtgaagaagtgaccacttgtggcttgtcaccgcattgcaaagtgcattgggagcttcttgcttcggggtgatgatctctgatcccagaagcaccaagaagggatcctacccagaggaaaatagaggtgaactggcctgccagagagtccatagttcataggtttagatcatagactttgcttctggccatgtcaaatatctgtcagaagccaaggctgggacttgcctgctgtgccttcctcatggcacagtttttgtcctggtcctcagtggaagctggcttttttcagcagttgagatgtttaatttgtgtgattctactcaggcctttccaagagtcctgttttccaaactggcttgtggagatttctggtgctcctttgggacagagagaaatttacatatatcacttttttttttttgagacggagttttgctcttgttgcccaggctggagtgcaacggcacgatctcggctcaccgcaacctccgcctccccagttcaagcgattctcctgcctcagcctcctgagtagctgggattacaggcatgtgtcaccatgcccggctaatttttgtatttttagtggagaccgggtttctccatgttggtcaggctggtcttgaactcccgaccttaggtgatctgcgcgcctcgtgcctgtaatcccagtactttgggaggccgagtcgggtggatcacttgtggtcaggagtttgagaccagcttggccaacatggtgaaaccccatctctactaaaaatacaaaagattcgctgggtgtgttggcacccgcttgtaatctcagctacttgggaggctgaggtggggggtaagtttgaacccaggagggagaggttgtggtgagccaagatggcaccattgcactccagcctgggtgacagagtgagacttcatctcaaaataaataaataaaaatcaaaaaaataaaataaaggggttaactcttctaaaaaggttctttttaattctatgattttctgatctattaatgtgactagcaattttgtgagatgtagtttgtcatgttatcactactttttggttaaaacactgtggaaaaccttgagtggtaactttatcttagtccaggtgattccagttgcagcagtagctaggtgccctgcgataactctctccccttgagggtttccagtgtgggaagttgtcatttaggcgcgccaaaagtggtctggcctctcgtgcttcttgagatcccttccgggctctggtctatcttgtctccttagctgggggcctacagtcatctagagtaaaagggatggtt

SEQ ID NO: 624 - DNA, 2276 bp, Homo sapiens
tcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgaggggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcctgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaggagtggtcagcctttcgtaccaggggaggagggaatggctggattcttccgcctaagtccagcagggtctgtctgactggggtgcttggatctcagggtggcccaaccgcagcagggtctgagagatacggaggtaatggtgccatggccacctcccggctggcacagcaccctgggtttcccatgcggtgccctggaattctccaggtggcatcgggcatacaaatgggattctaattcctgccccatcacttgggtacctcttgagcccctgtttctttacatgtatattgaagataaaaatagcctcagtgcagtggcacacacctgtcattttagcactttgggaggctgaggtaggaggctgaggtgggaggatggcttgagcccaggaagttgagacccgcctgggcaacatggcgagaccctgtctctacaacattttttttttaatagttgggcatatggtggtgcacatctgtggtcccagcttctcgggagggtgaggtgggagggtcgcttgagtccaggaggtcgaggctgcagtgagctgtgattgcaccactgtactccagactggacaacagagcaagaccatgaatctaaaaaaaacaaaacaaaacag

SEQ ID NO: 625 - DNA, 2818 bp, Homo sapiens
gttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatctgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgcc

SEQ ID NO: 626 - DNA, 2665 bp, Homo sapiens
tttttcaatatcactcttcgtggattcttctttatattaaatatgttgtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccggaagttgggggcttattcagacttcttaaaagtctaccttcttcctctgtactttcagcccaaagtgagacttttgagttgggaagagttacttctgaaactactaatcactgtcacccaattctaatcccaaccatctttattctaggcataccatactcactgccatgcttacccttcagttgggcacttttgtcctccttcctattggccttctggttcctacccaactgtccagtccacaggcttcaatgatacctttttcccacccctgtggtagtgttggctgcctcctttacctactcaagtaaccgctttaccgctaatttattgctctctgttttcatctataggatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaaccacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacggaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattcccaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacgcatccacagaggcagcgggcagagcaagcacagggccatcgttcctgcccttgtttcccagtctaattagtcacccagacctgaaaacatatgctcagggggtggagattttacaattaaataacattgtttttggtgccctcaaaaaaaaaag

SEQ ID NO: 627 - DNA, 2372 bp, Homo sapiens
ttttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcagggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaatt

SEQ ID NO: 628 - DNA, 2317 bp, Homo sapiens
tttcattcttaccatctccagttgaggaaacaggctcaggaaagctgaaagctaagtggcttgcctaagaatttgtagctccctggtagcatgacacccgaatctgaccttccacatccccggcaccttcctggaagacccacgtgggaagagcatggaggggagaccccagcatcgttccagagccaggtctggaggagccacctgagctgctgtcattccaccccctggcggtttatactgccttcttgatactgccacctccagtcactggtgttgggcttctgaggtgaccactctgccttcctgggggtacaggaagaccaaggtctacagaagcaccttccaggcttgagctcgttcacagcctgcctggccctgggctggggaacaggcggggagcagcctctggctccagagcagggtgggtctcaatgcatcacatccgtccttccggttcccagcagagcctttgaatgctctgcctcagatctgcagccagaggaaaagggggagtgggcagggcagactcagtctagggacgagctatgcagcacagccagtgccagctccccacgtgcctccccaaccagggtgataaaggctgacacctgggtgtgtagctgggtctggcccccagggcatcacagtgaccggggcaaaagggtcccacaagcgcacaggggtggaggctgatggcagagggaagaggcaggtgggagcccaaagacccaggcctcctcccccagccggcccacccttgtttgagcagagagcactcagttcctgtttgtccagttcccccaaaggcctgggctggggagataaggagttaacaaatgaggggaatgaggcagcctgggcgataggcaggcactcagccaactggtcacaccgctttactgctgggtgccgtctggccccaggcatagctgggtcagaaacccagggcccaccacagcctctccacctgctgtgggtgcagccccaggtggaacccaccctggctgagagcccgggggtaggcatgggccataccaggggctctgagaagcagctcccatcccccagcccccacaaccttctcctggctgttggctcttggcccagcaaggtccatccagagagaggcctgagttgacatagaggagggggagtccgggaggggatggataccagaggaaggagggaaaggcccaaatttgggaggccgggggttggagcactagcttggggtgatgaggaagctggggggaggcaagagaggaccctgcctctcctgaggagtgagcagagccagggcagtccctggggtccagggccaagatttcctgctgacccctgcaggagctgggagggcagagcctcagcctccactatgttgggggaagggctcccgggcccctggcacctggacacccacctgtccagagcctacagagaccctgcgtccccacacagcagctcctcacaccagagttctggtgcccagcactcctcagcagcagtgaggccacaggcagggcacaggcctctgtccctacgccaggtcctcccctaaaagggcagtggcagcaggggccgccgcagaaggaatggcagatgagacccaaagcctttggtcatcaccccggaggtctatgccaaagcctgggtggggctcccaggagatggaacagggacacataccaggcaggtccacgccaggggtgcggggccctgatgaggaaccgggctgcactggtcatggctgcacttgagccgccgccacctgtcccgcagccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttctgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgc

SEQ ID NO: 629 - DNA, 2195 bp, Homo sapiens
tttagttcatgccacagttgaagtttgtgtgatgtttcttagtagctaatttcaaatttttactgttagattctaagaaacagagtgggctaatgattggagcacagccatgagactccgctccgttagctgagcatgtgatcctgtgctaaatctttcttggttccttcatctttgaagatgctgtctgctacttcagtgctgactgatttgcaaatcttggttgattagctccccaatcataaggtccctaatgattagattaaatgccttatactcagggggtgtgcagatatgctattcttccttctgtggcttgggtggaaaagctgcttgggcttatttcccaacagtgtgatgtaggatggcagaacttatctaggaatggcacctttgatgatccatataatgaaatgtgtagagctcaaagaaatctgccaacatgtatgtggactcttgagaggtgggctttcccagtacatgctaaacagacttgttatgccaagaagaagtgaatagaaatgatagcatcaaatatccaaactgacaggaagtttcttttgcatagcatagaacatggttgtcttctgagttccactaatgttccaggatatcttggccctctgcctctggctgctccctggtgtttggcaccatagcgttgtcacttacaaccattgccttgggacacacagagtgaactgtttgagtgataagtaatttaggtagaaactttacccttaatttcaaatgataccaaacagctcattactaccccaagggacgctctccgtagcttctggattccccagtttccttctagaaacaaggactccaatagcactataaccctaaacaggccctaacccagaagaatacaccacaaaatgcgattgattttctcaaaatatcacagtcttagacactatacaaataattcaagaaaattctttctaccctgcagtggatatagtattctattatattctccagcaaaacttttaggacttttcaaactcatttctaagccaaatagtttagataaatatttacccttatatttggggggaattcaggctcaccatttgccgaggcaagcccatcaacagtctagaggcatattctgtgtcattccctcccgtctccttcatagaatactactttttccttttgtctcctggccattctccatcatctgctgattattgctaaccacaggatgctggcaaagcttacagtgataggcacatgtgttcagtgatgtccaatacactcttatcacagtggttattgcttcttactcttttcaaatgcattattctacccctcaacctatatccaatcattagaactatacctgactggagcccagaacttgggaccaatacttaattcaaatagcaggggcttgctcacaaacattaagcccaaaaagaagcacagcactttgaaaagtcaaataggcctttggtagctctgtacatttgcaattttacatttgttattagtttatagcactaataacacttcagtcgtgaatctacagtctcaatatgataagtcttagaacatgttctagaaatagtggtaccttgctgctattatacttagtaacttataccccaatataataataagtattaaatacagattgtgtatgcattctttgtgtgtatatgccaactgtactacttaacctcactgatgagcaattagaaaaatacacaaattgtcatagtgaaaataagtcttggtcaattcagatgatacgtgaacctgataaatgctctaatagatatgctattttgtcctgtattgcttgttttacagtatggtgcatgttgtttgctaagtaaaatgataataataataaagtataccaattttaaggttagaattaaaattttgcacatatgcttcttgatattctgaaatgtattctgtggcttaattatcttattcatacacatttcacttggctttttacccctaggaaataactgtccaagtatatatctcgtcttctttcttgtaactttgattaaactgcttacttcaacttacaacattgtaaagccagaatacctcattttaacagtgaaaaaaaatatgatgacctgatgtgttctcttgtatttgatttgaactacctaaataggcttaactgtaataataaatatacaattttggcaggc

SEQ ID NO: 630 - DNA, 2519 bp, Homo sapiens
tattttttcaaccatgctttattgtgtaggggccaaagggaaggttcctctttgccctctgaaggttcactgaaagccaactcataaaaggcagatttttggagaaaaggcaaataaatggattatttatttatttattatttatttttgagatggagtctcgctctgtcacccaggctggagtgcggtggcgcgatctcggctcgctgcagcctccgcctcccgggttcaggcgattctcccgcctcagcctccggagtagctgggactacagacgcccgccaccacgcccggcctttaccgccagttttcacacagaaaagcggggggaacatcagagtcgtgtttttaggttttgtggctggctttgggggtctggcctctgggactcgccttgggtaaaagggattcactctgtgaggagcctcgcgggagaaaagaactgagactggaggcctgggaaggtcagagggaaactgcctcccaggccttcattttggggcgttgtgttctgagccccgataattgtaacatcttcataagcgactttctggtggttatggtgaatcgggacacacgatgtatggtgaccgacgggggagccgggagcccagcggggttagggttcaggtgagggtttagggtcggggcgagcgcggcgcggcccggatgcgcagcgtcaccgcgccagaccctccgctcagctgccgtgggctctccccctccccgaccatagacggcgcaggcctccagtcatcccagagcggccccggaagaatccgggcggaaccgcggctggcttccggttcccggcgttctcggaggcgtactgaggccccgcagggggcggggaagcctgcgtgtgcgcagctcggcccggcccgccctcttcatcctagcccgccccctccccgactctggacccggttctgtgggagggtccgttccgggctcggtgcgactgcgcagctcctcggcgcttcctcggtggcttccccgggtcgagcaaacaggtggggcagtgtcggaccaggaaggagcgccaagcgggcaggcaggcggggagggcgcggggagggcgcggggaggcggcggccagtccaggaggagcctgttctgggtgccgcgggagccaccgacgggctgcagaggccgggaggaggcgaccgcggcgtggccctagaaggctggactgaggaccacagctggcttccggcctctccccggagcctggggccttcggcagcatccccgcggcctccttctcacgtcctcagccttggtgaggctgcaccctcacgtggctctttgccccaggttggccaggcaggtagaacggccctgcaccccatttccagggccttcagcaggtctggaccacgggaactgccagctttcaccccttagccgggcgtccctggatccccccgggctctggctctggccgttctgggatttcaggagtcactgagcagtagggcacgtcggcccgtgctgcatagtgacctgcctcccgcgacccaggagaccacagcagcaatcagcttctgcctcctggccatccttccacacccctggttgaatggggctgagcctgagttctccccactgaaggtaagttcggggagacttcaggccagggcagtctcctgtcttctcttggaaaccacagcagcccatgcacacagaatggcagccacattccagcttccagggcaccaggtgagttaaccctccttcctgcccacctcttcatcttcatccccatcccagtcagaagctactctcctctggagccgtgagcccggcaactggtaaggccagccaggggctcatagcaaccgtgaggaaagggttctgagaggtagactcgccctcctgcagggagaggggctctgagctcagctgggtccccgtgtagctgaagttggctggtcctcagcgctctcagctgccccatcagggacctgctgatacacagttcatactgaccacagcagggccctgggtagtggggccccaccaggtcagggcccttttagtgcaggctgctgccccgtgggcatggcctgggcagcggcgatgttttgttgcaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagttattctttcagttgctgagagaggggtgttaaaatacagaagtatgattgtggaattgtcttttcttcactttaatttttgtagtgttggcttcatgtatcttgaagctgtattataagacttacttcacttatgactatcattatgagagataagagaattcctgtttgtctctggt

SEQ ID NO: 631 - DNA, 2181 bp, Homo sapiens
agtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtactgcctgtgcctgctgcttgaatatttccgccttttagggtgctcgcgcaggaggctgcagcgggggatgggtgctccgaggctcccgaggcccgcgcaggtcacgggtgcctccggctgtgcattctacctgcaggtcctttgacaccagagtgtttaggtttcaacacctctcccgctaggtaacaggaagcagatgagctccgtaacaacagacacacggacttgtcagattccttgttcgtatcagggttcttgcacagttaggacggcttcagagaatcctacctttcctggcgctgtgtgtgctggatttcatagtcacgcttgttagctgcacgtcctcggtggtcagttgtgagagcccccaattccttcctccttagaaagctcattctctgaggtttactggggcttgaacctggggctataaggagtttcgagacactcaaaaacgagctggggcttgttaatcaagtggtttttgtccatgagaagaaagaattggttgtcaagacgtcggacctatagtgattgggtcctcaaatacagtttggtgatcaggagttgttgctttattgctattctaatttcacttacctccccagaagtaacctagttaagagcatttccaggccttcctattccttcttttcctaaacggtgacttctgccatgctgccctaaaatctttttattgtgcattatatgtgatttataaaattgtgacccagtcccatctcgagttttgcagcccaaactgggaagagttctgcattgtactttatccttgtgtgtttctttggctggggtctcaggaaccctgcacgactgtatttactttcacttcagacttactgtttgtgggagtgttttggggaaggggccaaatcctcactcatttttttatttctggtgctcgttgagaccacacagacatggaaaggccgcaggaggtgatgagacagagattaaccgtgccgaatgaaacaaggcttcctttcggggaattcagcagaaaaacctttcgtgagattggagaggaaaatatgtctgttctgcttggcaggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaaggggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggtgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactg

SEQ ID NO: 632 - DNA, 2536 bp, Homo sapiens
aaaaaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggtatgttcaatgaatgcgcaatacaagaccatgtgtggcaacatactttttaaaaaattatcgcaaccaaagtaatatttatcctttggagtggaaaaaggaaacttggattaaattcatctgagtactccatgtttttgcctcagccagagttttagatgctttttaaaattaactttcattttcattaataactccaaattactgttaccccaggcacaaattatcctctgtagcaataatgaataaagctccaagatgttcggcttaatccatcagagagttcacaaaaattaaaactaggaaacatctgctttatgatcatgtcatatacaggggtggcatggggctttcagaagcatttttgtgccccagaaatgcaccctgcagatcactacttccaagagtgtcacgtgctaccgagcttgcgcttaagtggatcacttcagtgcaaacaaaggaagcagatgaaattacctcctgtttgtatgaccacttatgaggattttggagaagaggtttttgggctacatggagggtagaatggttagtctttagggttctttctactttctaaggatctgggattctatgagaagtaactcagaaaggcaatgctgcttagctttctggtgacacattattacaaattactattactataacaaattaagggcatagtttggagacattttgaatcagtatagataaaacttctgtcccttcttaatttcataggcagattaactctatggagtgaccctctccccatagacggcagttataggcagctatgtatatagcaaaatatgacattctcagatcaagtagtcattactcatgctcttcaaagtgcaagactaggacccatttcaatcatccattacactccactgcaataattggtgggtctgtttcttacattatgacttcttcctatttggcccccagtaaatatctggcacctagtgggcctctgataagcatgtatttattgaatggatcttattttattgaaatgtatcctatttcccagaggaggagaagtagggcaggcatttcagaaaagaaacagcaagtccacattgttccagggatgccacattgtcctgggtagtgtatttgggggacatttgtaaaattgcttttgaatgtacagactacatggagcatcctgccttgcctaatcatagacttctgtgttcttttccatcagtcacttcctcttagctctaactccttttctccaacctcctctcacctaagcctctgaacatctgatctctctctctttaaagcttttatcaaaggaagttttaaagtaagcttcagggcttatatcatgcgcttaaattatgctgaccatatctctaggaatttctgtacaagctgcatgtaatcttaccttttttaaaaaagataatttattacatgtgcaagtaactgtgattcaagttctagccctttatacattttttttcttaaatcagtaagaaaaatgtcctttatccaaccctatgatccaatttttctccctgaaaatgtatggattacttaatacgtcccttgaaaagttcaatacattgatgtgaacct

SEQ ID NO: 633 - DNA, 2578 bp, Homo sapiens
ccagggtggggcgaggggcaggtcttgcagaggctaggcagaggctgctctatggggaggtgcaattggaaatgagcaacggtgcacagtaagtgttaaccccgcgcaggttaaatgtccagctctgagagctgctccctcactccccctgcctcaaaggtgatatttcccaccccctccctaggagagagtagcccctaacagatgctaatctgggtctagctctgtccagatggctgaggttgggcctgggataaaggtggaattagggatttggggcaggggctgagaaaagctgtcccagcacaggcagcggcatccaggtggagacaaaaccagcaaaaaaggtacattctcatgctagagctgaggctgttgccagcagccaggaaacctagcccgggtcgcaccttgcaggatggaggggaagaagtactcagtctctcccactcagccttacagatgggtaacgagagacctagctgggaggcggtactcctcctggctttgcacagtgcgtggggggaaatggttcctctcccccaacccaaaggggaagcaggtgggcgggcgcatcccaccaactggccaggagcctctgttacattgtggctaaggagctgcctgccaggggcagccattgggccaccgctgatagtgcctgtcctcttggtactgcctctgcctccctccgctaaggaggcaccttgcctgcctgctgtcccatagtgcccagccccagccccagccccagctccagcccatagaggagggaggaacactggaagggccctgagcaccagggggcaaggccgggaagaagatgggtatgagctcaggattccacagttagtgcttcaaagaaatgctcatgggaccctgcaggagctttcagagtcccccacatgctctctggtgaccctaactcgcagcaccatctgctctgtgcccatgtgctgggcaaggggtctttcaaggccagtggggaggatgaggaaggaatctggttgtcctggctaatggagcatgtccttggagttctgggggagatgacaggctctggtctaagaggtagggacaggggttctgtccctaatgagctgtgtgccccgtgcacctccttcatagaatacgaggacgggatagaaccctgagggctccttccagctcccagagtcctgattccagggctgtgctctgtcaataagtgtcccccagcctgggcagaccccagtcccttctgtaaggtagacgcaaagcaaagaggttatgaccggctcacccaggggcctgggaaggctatggccatatgcccacttcactctgcaggacaagtggcctgtccccactatattcacctcctcacccctctcccttggatggaccagtggtggtgtcacccaaagcaaattgacactatttttcccttggtaaccgcaaagggggagaatcacccgtctcctaattttaaccagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgc

SEQ ID NO: 634 - DNA, 2973 bp, Homo sapiens
atgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattccgtgattgattttggtcctcctccgctgtccctcaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctc

SEQ ID NO: 635 - DNA, 2636 bp, Homo sapiens
cccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacgtaagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaggagagtggtgt

SEQ ID NO: 636 - DNA, 2655 bp, Homo sapiens
gctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacaaagtgtgtctgctgaaatgctgaggtccccacgtgtgaatgggtgaggctgatgtggatgtctgtgtgtgccagcaggtgggtgggggatgtgggtgtcagtgtatgccagtgggcactgtgaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttgggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgggtgtgtgtctgagaatgtgtgtgatgtgtggagtgtgcgtgtgtttgtgtgtgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttgccctcttgttgcctgcactcatttcccagggaccctcctaggataggaatgccctccttcctggccccctcccgccatcctcccagccacccacataatcaccatctcagcccaactctggtggccctctaggtctccatgcattcttcctgccctagagtagccagctcaccaaggcctttatccccagcccaggagaagggtcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagc

SEQ ID NO: 637 - DNA, 2410 bp, Homo sapiens
aatttttttgttttcttgtatttttattagagatggattcttgccatattgcccaggctggtctcgaactcctgggctcaagggatccgcccaccttggcctcccacagtgctctggatgacaggcttgagccattctgcacacgcacccagctaccctcttgcctgctctgtgtttgggtggttatgtgtttattggaggcagtcagtttgaaactaactcatggtgcagaggatggaaccatggaagactgagcagtctggattcaagtgtggaccccgctctgctgtgtgagcttgggcaagttactcaacctctttgaggcttaggtcccttttctggaagaggccataataatagtagctgcagtattgccctggggattaaatgagagtgtgaatacagagccgctcacctgtgctgggtggtgttctgtgtgcgagactctctggtccctgaagaaggggtaataggggcccaagtgggagttgactgggcccctgacaccccaaggggtgggcactacaagcactgagcagcctggaccctgggttagagcgattttcctgatcctgcagagcgtcttcactttttaatacgaggtgtgtctgtcgggcgcaggcccccgcgtgtgccccatctgcacccctgaccagctctgactcactcctcctgtctcctgcccccagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaaaggcctgggcaagtacatctgccagcggtgccacctggtcatcgacgagcagcccctcatgttcaggagcgacgcctaccaccctgaccacttcaactgcacccactgtggcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgttcacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacac

SEQ ID NO: 638 - DNA, 2582 bp, Homo sapiens
aagggtccattttcctcactatattctgcaagaataagatctccatctttgcctgtgagatcctgaggtgtgcgcataaaaaacaactctccaccacctgaggcttgcctctcttgttctctcatcttggccttttttttgatgtgctttagcaaaggttggactgaatggggacctggctgagagagtgcaccaaatgagtactttttcagaggtgggcgatggaactgccggattttgatgggccccatgtgggtgggaaagaagggctgccataattccatagcaggaattgaatgctggataatattccctccaaaggtgccccgaagaccctgttgcttggggaaataatactcatcattggagagattccatggatctttcacttctggctgagacatgttctgctgtggttcctccctgatgacacctgttttgcccaagagaattcgactcttcttcagagatgattccttcttactctccttggagggggagttagaggtggcctcttccttctcatcaggaatttccaaaatgaggttctcatcattgggatcaagtgccaaaacaggaggttccaacagccggggcatggcctgagcatcccaaatgatattgtcctcccagcgtccatacaccagatcctcattgtcaatgggaaaaatggagtaccaaggtttgtcatcatccagagtgggtgcaaaaccttgctgaacattgtaagccattacattcctagtcttaatagaaggaagccagcctgccaggcttgcaccctgaggttttgtccctttgtgtttgatatcctccccatcccagatgatagaatcctcccaatgcagctgtgtcaccatcaggaagttttcgtcagccagaagatcagtgccattgctttcctcaagtttcctaaattcctccatcattctagattttatcacaggttcatgttgtgtctttctcagtttgaagccatagtcaaacccactgccatcttcggagacacccagcatatcataccacagtcgggcaggcccataacgccactcagccactcttggtttggtatctgtcactttatctacatctccagttgattgggaaaatttggactccacaggaaccatcatcgtgatttcatcatcagcgagacactgctctgggggtggtggtggagcatagtcatagttccacaaagacttctggctgacttctgattctactgagcattccacctcctggatctgctcttcctgtatcagctcacgatgcttcttcctctttctccgagcactccgccaaacagatgggacattcttccctggtccaaaaagatgtaggaagcgtaacacttttccaggtcgaaattctggaaaaagttcggtgacacttggcaacagcttggtggcatcatgctgcataatcccagccaatggaagggtcagctttccatcctcagattctgcctgtgttgcttcctgaggtcccatctcagattctgaatcagagtaactactgaaatccactttctctgaggccaaaaaggaaggggcaatgatggagggcaagatgatgtcttctccactttcagacacacagggctccctcctaaaacagccacttaggaacaagagccactgaaaagtgatggatgtcctcccttgacaacccatagcaggaaccagcttgtgtagcagtgacactgcaaactaaggaagcagaagccagatacatgcatcccttgccagggggctcccagtggagtcttgtagactatgttacagtgtgccgtggctccaattcaattctaagctctagttgtgtgactaaaagcctaaaggagaaaaaggaaaacaagcctcaaagtcctgcctgcttctgtcttctggcaagaaactatggctatacatccaggagggctggaagggctgagtggcattatcattttgtaactctcttactcaccaaaaacacaggagaggttttcaaatgaatgtatattcatgaggaatattttttaaagacagtagaaagaatttttttaaaaagcagcatcatcacaaggcctattggttatctctgttcagcaacacacatttaggggtcatgtcagaaaatggtatatgctcaaaggatctgccttcctttaggtcacacctttacatcatccacttattctggaaacaatattgttcgttcccatgggctgcttaagatttctacgatatcacactgaccagaatactttgataagttccattgctcaggatcctggatttttgactggtcaagccccatccaaggaactgcagcacaaaatagatgacttagaggtcaagagcctggctttgagccaaagagaccaatcattagaattttggccctgctcgttactaccttgtgattttgacaaattacttttctttctaagcctcagtttcttcttctataaacaaaggccagaaagatacctacttcataggattgttactaggatcaaatgagaatgcctataaagtgcttagcatagtgcctggcacatcgtaagatttcaataaacgttaaatgctttcccatgc

SEQ ID NO: 639 - DNA, 3185 bp, Homo sapiens
gaataaatattagctttgcaattaaagataacagtgtccattacatgtcagacacgagggccaagcgttgcatatattacctaatttgtttttcattgcagaactattattctctttttaaaaatcaggaaaccgggctttgaaaggtaattttacccagcttacccagcaaatacagtgtagacctggacttccgactcaggtctcattggctcttaggcccctgggctcgccactgctctttgctgactcgttgtctttgattaagacactgagtttcagtctgttcctaggccctgaaaggatggtagataggccacatctgcttttctttcggaggaaacaaatattattttattgcattatgctaaaggctgtcacagatttataaaattgtagcaaagtgcctgaggacatgaagggcctaaatcagaggaatagtagatgaaacttcacaggaatatatcagacaacataggcgtctttagagaaaaggaaggggaaccaagagttccggtcctgctgcccactgtcctgcttggacccacaagtgagccagggcctcctgtggcccctgcttacctctgtgctccctgtcctggaggggtagagtgacttaggtgcttttgatggaacgattaacatcacgcctggcctggcgtggctccgtctcccgtctttctaggagatgggaaataaggtcctagagttttgtggtgctttgactcagctttcggtctgctgagactcactcacaaatgtgtcattccgttctgccatccgctttgttttctttctcttttctcagttctcagaatcttttttcctaattattcaaccaacttgttgacatccttctcatgcctatgacaggaaggcagtcctcaccccagagtggccctaagctatgtctgtggctcaggagccctctccacggggcctctgcctgggatggtccctgtgatgagttaagtgaataaatgatgagacatacgtgagagaatttcacctggtaacaccctttgttttttggaccaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtattt

SEQ ID NO: 640 - DNA, 2806 bp, Homo sapiens
ctttacattctatctctaacacccatccctgctttgctccccgcaacacacagccttttcctcattcccctcagaggaccccacagtggctgagcttcctgttctggatatgcctggccgagagaccctggcctgacactgtccttctgggtttcaacatgaatttccaggatgggacctagagcttagggacccacgtctccctccgtctagtgccttagcccctcctgggtcaggcagcttcaccaatcagcttctaggaggagatgctgtccctggctatgggacattccttgagtcattcctgtgtccgcccagttgaccaacatccacatacactggttgctgatgctgtctgcagcaggagttgggccttctcacatggagccccagggtgctggggaggccaccccatggtgattcagtggctggcacagacacgctgggtctgctcagacacagccagggcagtgtcattgtctcctggggatcaggagaggcctggtggaggaagggaccctgggggacaaggccgggggaggatactctttccctgtgggccttattcttccattcattcactcaacaagtacaggtcaggctcccgggacacggcaggcactgatggtactggggcacagcgatgaacagagagagatttgctcactgccctcaatgattcatagggcagccagcctcgccagggtgtccgtgccaccccccgcctcctgctttccccttgtctgcctgctctgttcatccatccatccgcctgtccatctgtctgtccacttctgctgcgctgaccccatctagtaactcacagttggtttcttgtggagtcttggctctctccatcccccaagcagggttcagtccctgaggcagttgggttcttgttcccaagttgatcaccccctcctcctggtggggacaggggtgagagtccagtgatccttctgcctagatcccaggaaaggtctaagttcagaggccagggactggggctagttcagaggaatgacaatagtgaagacagtggcctgggctgggcacagaaacctgagtcctttccacttagtgcctggtcccttcatgccctgtgcatgctccacctcccagcccactcttgagtaattttacccccaccttgcacctgtctcagccatcagagggattcatgctctgacctccctccgcattaggactgccaggacagagcagcagttggccccactccaagtcactctaacccccttgccttgggaacctgtgcagaccagctctgggcaaagccccctaccacctggcccacccccctgctttccttccctccctctcaaggggtctccccaatggcttcacttagtctggtcatgatggtggagctataagagacatcagctgggactccctgagattggtgtgtgccccagcttaggtcaacagagtcgtgcctactaagctcctcctgctcccaaatctgtcccattcaaagagagccaggtgcattactggggacacctgagacagaactaaccaaccctagtcctgggccagggctgctgactggcggctctggaggtaagagggaggccagggagccctggccgagagtcagtaggctctgattcaagccccaactctgccctctctgggcctatttccccattgtacagtgggacaagagtcctgctggtctcttgggccacatccagagaggctctggaagtaggcagggtctctgctccaagggagggctgaggagagacctgatgcccacggggccatctctgcaggtggcgcctgggtggcatacggagctacaaccctgagcagatcatgctgagtgctgcggtgcgccggaccagccgggacgtcagcatcatgaaggagaagcttattttctcagcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccctgtctctacaaaaaaaaataataataattaattaatttgctggccaaggtggcacacgcctgtagtcctagctactcggtaggctgaagtgggaggattgcttgagcccagcaggtcaaagctgcagtgagctgtgatcactccagcctggatgacaaagtgagatcctgtctc

SEQ ID NO: 641 - DNA, 2179 bp, Homo sapiens
taggatccaccataaccctggtgtcatcatctcccaggatccatgaggtccagtgctgtctgtcaccatccactagtatccaccataaccctggtgtcatcttctcccaggatccatgaggtccagtgctgtcaccatccactaggatccgccataaccctggtgtcatcatccgtgatccatgaggtccagtgctgtcaccatccactaggatccaccataaccctggtgtcatcatctcccaggatccatgaggtccagtgttgtcaccatctactaggatccaccatgaccctggtgttatcatctcccaggatccatgaggtccagtgttgtcaccatctattaggatccaccatgaccctggtgttatcatctcccaggatccatgaggtccagtgctgtcaccacccactaggatccaccataaccctggtgtcatcccagagtccactgtaaccatgtgccatcatcccccaagagccatcatcttaggagccaagtaccgtgacgggctgtatttcagttgtcctctggggccgcatggtacttacagttgttcacttaaggggaaccagcacaacaggccatattcccgtttccactaaaaggacaggggtggggccagctgtccccctctgaagacttcacccctactctggccctccttatgtcactgcctcactcctgaccgaggatgatgcctgcatcaatcccaccacagatgtggcctcagccaacctcaccttaccccccggtgaggcacccaggccccccttgacagcagcgctgtccctcacccagccatctgattggtgacagggtcaacccagcaacctctcattatcaccagagaggaagcatttcaaccctcaggtgacgccactgccccctgcccaatccctgtcacttgggcccctaccaggatcagcactccactggccccggccaaattctcctcagagatccctgacccccgcgggatgggtcaaagctggtgaccgactggggccttcagtgctgtcttctgctggcctcatcctgcagcagggacactggagagcaatggtccctgccagcacatctgcggggaccaggggtgccccttcacctccctccctaacaccttaacacccggggagcctccgggggtggcaggaagtccccagcacccaatgcacaatcttccctcaattctctttgtacatagccatgttgcgggggcggccattcccccactcttaaagggctacacgcccctcccccagcccctagggcgaggtggggggggcctcttcttcctcccctgggccgtccccctccctcttatgtctccccgcaaacactggcacctcacactccttcttgtcaggagcttggggcagacaactggcccttggttcccaccacactgaggaaatgggggttacccaaatccacctgggccctggtgccagtttttcaaccccacggcttctagctgctctgaggggctcctcccatcccttccagggcctccccagccccgcactgctcaggccaactgtgacttccccagaaaggagccagcttgagcacccaccccctcccagccccctcccctctgctcaacacctccgcggaacactcagctttctccagctgccgggatttgggggtctgggcctttcagcttttttatcccccctccactagctctagcccagcctggattccagggatcccacccctagccctgtccctattcagttggcacaggctgcctgaccctggggccttgatttgatctcaaataagccatagaggagagaggtcttgaggggtgggagcaggtgtgtactgacaattcccctccacatgtcttgagctgggacctcgtcatctgagacttccccatgccccaacaaatgcaaatgcacacaaacccatgcatacacaagcacacacacacaggcatctccccgtctggttgggggagcatgggagggggcacttcacagggagaagataaatagttccacacctgaagaccctccaacagcttctgcctccctcctcatcacttcctctctccaccccctctccaacactggccccttcccctaattaattccctggtgaggacagccagaggagctgcgacttggtattttttggaataaatagacattttcctgat

SEQ ID NO: 642 - DNA, 3877 bp, Homo sapiens
gactgacgtcccgccctctggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcaggtaatgctggactacatgtgtacatgcatctgaggatgtgggtcgtcggggaggttaagcacagagatggcctctccatccagtcttctggtggatacaagccctggatgctgctctctggaattgtggcctggttctgggttgaggatcctatggatcctctagtagacattgagtacagtatacctctgcaccagctgcaggccatggtgccagccacagtgggagctagtccagtgttctatcaatagtttgcctcttggattttccttcagaaccttcctcacttctgctcactagacagaggagcttctaggaaagggtaggggcagagagcattgccattaaagaacagagagagtattggcatgagtttcaacatctttctttcatgtgagaaagctctgcagtgtcagagttctaggcaggaactattgccttggcaatgtctgctaatcagtcagccattctataagctagggttttttgggcttcgttattcatccaaaagatgtataatgatcatctactctgatccaggttctttcctaagtgaggaagcatacagtggtgaaccagaaagtccctgccctcatgggcacagccagagctaggggagacagggtccctgcttcagggacctgagcttataacccagatgggagatcagtctcccaggagactgatcagtgcaatgcagcactgaggactgggtaaggatgggccactcctgctaaaagggctgtcagagttcccaaagggctcttggtcaattgccatcgctcaagcaccaagtttagatattctcctgcactgactcttgagtccagcctctccatccctccctgtggcactgcctcaggaattgtgcatccacttgcatatgaatggttgcacagtctcctaaatcatactcttgaccctaatctttcccttcctgcatgtggttcagtctcaccctcacaaaaacatgttcccaacatgtcactttgcctactttggaacctcagtgtatcctgccttgctaggataaagtcctaattccatagtctgccattcaaagcctttcagtcggccgggtctaccctcccatccaactctgtttcctgtgctctccctactccagttcagctaattgaattctttctcctctactaattgacaggcattcctgcctctaagcatttgcacgtaacagtcctctctcttgaatacccttcccactctatggatttcagtgcattgaaatcccgtgtgcatacagggcctagcccagatcctgctctcctcactggactcttccattactgtcccagctctcctccagcatataattgtctatgcctctgagagccactgagcagaacctgcctggcgtagtctgccacatatctcttttagaccttcctggggacccttgggtgtggggatccaagtctgaagtattttgtattttgtggcctaggaggtgctccctgagtttgttgataggaggctagaagaagaggtcttgaagttaaaccttggagaaaggtgggatttggagaaattgagaggctcattaggctcagatgggtcagacctgaggcatccaggagagttgggggcaggatggaaatgtgcacctagagaagggggcagtggacagagtcactgtccaaagctctaggacctagccatctcccttgccaggtcctcaggcccttacatgggctgattagcaatgcccaggtttgcttcactgcaactatcttgtccatttttgctttagaggagcagtttatcctttcccaggttgcactcctggagcaggtgaatgccttggtgcccatgctggacagtgctcacatcaaaggtatctctctggggttatagcttcactactctggttggggaggtaggtggatggatgggcaagactttcctgtgtttcaggttgtgtggattcgggttgggtctgttccttatcttttttttttttttttggacagagtcgtactctgtcacccaggctggagtgcagtggcatgatcttgactcactgcaaccgctgcctcctggttcaaacaaacttcccacctcgcctcccaagtagctaggattacaggtgtgtgccaccacacctggctatttttagtagagacggggtttcaccatgttgtccaggctggtctcaaactcctggccccatgtgatccacctgcctcggcctctcagagtgctgggattacaggcgtgagctactgtgcctggcctgttccttatctttatcctcaccctgaggtacttgccacatccaccaattaaaattaccaggatagagagcccagttttaggacctcaggcaatttgggcctgagaacactagcctaagctctagcagtccccagctctggggattccttctgccttctacctacccccaagcatctcttcttcaaggtgctgcagaacccagattttactatcagagtctctgccaggtccatgaatgtatgtgaattctttctgctgcactgctgagagcagtccctgggcctggactttgacaagcagatagtggctttaattgaatccagatatccatcttgtctgtctgtggaggtatttttcccagctccccctccctacccctgatcagctgcccgctgagtatctgacagccttaagctttgagcccagcatggtggccaagccttggcgtgttggattccagcttagggacctggcatccatcttcagactccctgttccctaagccaggcagacctgcccccgctgggctgagagcaaagggacaggtcctataatagccaaagctctctttacctggtcctgcttatagcactggggtgggggtagggagcaacactgggaaccccaaggttttgtcttctcctcgggacatgtatcttcccctcccctatgggtcctggagtaagactggagtgggcagggagccccactgccacctccagctgcagcagtcgatgaagtctggcgtttgtttagcttctccactcaatactctaatcctgccaaagacctaatagactattgagcagtcccgggggagggcacaagcatcatccagcagtgtgtgttgtgttttacagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatg

SEQ ID NO: 643 - DNA, 2305 bp, Homo sapiens
aaaacagctcaaaaaaagactaaaaacacagctctacactttaggaggttggggcaggcagattgctcgagctcaggagtgggagacaagtttaggaaacatggaaaaaccctgtctcaaaaaaaaaaaaatttgaattagctgggtatggtggtataagcctgtggttccagcttctcaggaggctgaggtgagaggattgcttgagcctggaaggtgaggctgcagtgagctctgatcacaccactgcattccagcccaggtgatagagtgagaccctgtcttaaaaaaacaaacaaacaaacaaaaaacaaaaacagctctaaacgaatgtggctagaaaagtagctcaagttgttcctgtctggtgaaatacaaacataaatgaattatttatgtgccagtggcttcctgatgctgagagcaaagccagttgttctggcaggttctggaaaaatttatcacctcatggggttcaatgccaatgtcaaatcataaatataataatcaaatctgaaagtgaacccagtttcagagacatccagaggccactgtgtatgaagctcctttcagataaagagaagatattatttgacttcttatctctgttgtctagcgcaatgtccagaacacggcagatattccatatgcacagtcacatcctatgtatgtgtgtttcttttccagcagggactggaggtcctaagctttgtttgtatgacgagccagtgcccaaatgagcaggagggtcttagcacagtcacctacacactcatttcgatgctctgaccccttatcttagctggtcaaagcgtggtctatgagtttgcattttaataagatcccctggtgaatcttgtgcatgtcaaaggaagagaagaactgccctcaaaatatagagcaggtgaactaaattattaacttatagaggtaggctggctatttatttatgtatcttgttgatgggaagattcaaattgatatacataatcacccccataaggatttcaggtaaaaaacaaacaaacaaaggtttagatgttagatatattttacaattaccacaccagtctttttactacagcatctagtaacacatttaccatagatttagatggaaattttcatcccataagcctttgttagtatttttaaaattgaatactcaataaatagtggccaagttgaatctcttagaggaatctcactcaaactacagtcatattttccaataggccccacaaaaatcattgctctagagtaatttaatatatttatccacctctttagacacttaggtaagtataataatacaagttttgtgcgtgtgtgtgtattgtgtaccttgtggcttcttgcccagtttctgcaacacctgaagctgatgcatgtttaatgtaaataatgtccagcaatgttacaaatgttgacttttatgtgcccatcaggaaaaaaaagatgaatgttattgtagaggaaattttcattctggaaaaaatgcatactatttgaatattattttcatgatttccacagatattacacacagatattatattccaaggattatgtttcaaagtcatcaaaaatagaaaatacatctatatttctaactgaaaataataacagtaagtagcccagctttggggaaatgtaataaaaatattaatgaccatcacaactcattaaaagcataaattgtgcaatgatttaaactacatgttcttcatatgaatgtgtgtagaaatatagacacattggataaatgctatttaaagtctgagtgcgttggtaactgattcagtcatctgtaggttgaagtgattacttttatctgccttcatagtgagaattagatttctattctttgtaaagcagggaatatagattgtgcatggagtaaaagaattcaatccttattaataatgatggtagctgcgctgcagaaaagaaagcctgtcagagtaacttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggttt

SEQ ID NO: 644 - DNA, 2243 bp, Homo sapiens
aaatggctcgaattgttctccaaaacagaatttactgaaagagcttatagagtccatgtcagcagaaggaaagaaaaggaaggagaagaattgatacacccttttttaaaaaacccccaagccaatattaatgtagtctcattcaggttcttattttagagggaaaaaaatagcatcaaaatggaaaatggagagaaaggaacaagccaaaacaatttaagtgatgaaaaatgggggaacggacagagcgaagggaagagggaaaagctggttgtgtctgggtggttcaacacatatgtctcaagactaaggaggacaggtaggtgtaggggagatggaatgctggggagtagtgtcaggagcagtgggatgacagaattagatttctgcttcaggccgggtgaggcggcctgtaatcccagcacgttgggaagccgaggcggcagatcacctgaggtcgggagttcaggaccaacctggccaacatggtgaggcctgtctctgcaaaaatacaaaggttagccgggcatgatggcgggtgcctgtaatcccagctactcgggaggctgaggcaggagaaccacttggacctggcaggcggagcttgcagtgagccaagatcatgccattgcactccagcttgggcgacagagcgagactctgtctaaaaaaaaaaaaaaaaaaagatttctttctcagaaagatggcggcagggcagaaggagtgagagagaagccagagaaccagataagagacagaactacagccaaaagtcaggctctggtttctgaggtaggaataacaagaagtggtcgggtgcggtggctcatgcctgtaatcccagcactttgagaggagcccaggagtttgagatcagcttgggcaagagggtgataccccgtctctacaaaaagatgaaaaggttagccagtcatggtggcacacagctgtggtcccagctacgcgagaggctggggcaggaggatcgcttgagcctgggaggtcgaggctacagtgagccatgttcataccactgtgctccagtctgggtgacagagtgagaccctgtctcaaaataaataaataaaaggaatagcaggaagtgatggctgagtaaatgtgccaggttggggaaagggagaaacttaggactgaggtttcaggattgtgagactgtaggtggctagtgggattatccactaagataagaaacataggacgatagcttttgggaggcggaggaactcatctggaattgatttgcttgtggaatatccagggagaaacccctggaggcagttggctgttgggtttaaactgatagaagaaaagaagaaaggccgaaaactgtgaagtgacagaaagaagggaataaatctaaagatagtagaaggaaacaaataacaaaataataaagatatagcagaattaatgaaatagaaaccaaatattcagtaaaggggatccacaaagcctaaagtgattctttgaaaatattaataagacagataagtgtatagtcagggttctccagagaaacaaaagcaataggatatgtatctatgtagacagatttattttaaggaactggttcacatgattatgcaggctggcaggttccacagtctgcaggttgggtcggcaggctggagacccagagatgagctgatgtttgcaagtcaggtccaaaggccatctgctgctacactggttggtggaggtcactctttttgttctcttcaggcctttgactgattggatgaggccaacttgcattatggagggcaatctactttgctcaaaggccacctacttaaatgtttttttggttgttgttgttgttgagacagagtctcgctctgtcacccaggctggaatgcagtggcgcgatcttggctcactacacttcccgggttcaagcgattctcctgcctcagcttcccgagtagctgggattacaggtgggtcccaccatgcctggcaaatttttgtatttttagtagagacggggtttcaccgtgttggtcaggctggtctcgaacccctgacctcgtgatccacccaccttggccagagtgctgggattacaggtgtgagccaccgcgcccggcccacccacttaaatgttaatccactcctaaaacacgcttaaagaaacattcaggttctttaaaccacatatctgggcactttggccagccaaattgacatataaaattaaccatctggcaaaattaatcaag

SEQ ID NO: 645 - DNA, 2227 bp, Homo sapiens
catcacccccagtcttgtggcttcaaatgctatctgtgtgtggatagctcctccagtccacacctcttttctgaatcttttttcaaattcacacatgtgaatttgaattccaggctcatcacatccaggtgtgttccccacacctccacctgaatgtctattagaaatctcacacccctcttgtccaaaactgagctcttgatctttaaccagaaactttatctcagctattggcaactccaggtttctgttttgctcaggccacagacttcagagtcattctcacactgccttttctctcatacaccattatgtacctgtcagcaggtcccaaatatctagaatttgattgcttcacatccctatagcaactctcctggttcaagcccatcatcatctggatttttgggaagtggtcttaactggtgtgctgcccttcccctctgctctcaaccctattttcaacatagcagtcagaataatctaaaatataaaccagatcatatcactcctctgctcaacaccccctcccaataccttcatgtcatcctcagagttattgtccaagcctctaactgtggtctacaagtctttacatgatctgtcctgttacattttccactctcgctccagacctgacctaagaggcttttctctgaacttgctaaacatgctcttacctgagggtccattcccactgcctctgcctggaatgctcttccccagacatgcatctgcgtggatcatttccatgcctcctcaggtctttgccctcatgaagccttccctgacaaccctatttaagattgtaatcccctcccacagtggcccctatctgctagagactgaatgtttttgtcccccccaaaattcctatgttgaagccttaatctcaacataggaggtttggcctttgtgagttagttttagatgaggtcatgtgggtaatagaattagtgcatttataagggcgtgaagagccctcactgtgaggaaaccagaatgtaagccttcaccagaacttcttcatgctggcaccctggtcttagacttcccagccactagatctgtgagaaagaaatgtttgttgtttaagccaccctgtctatggtactcttgttacagcaacctgaactaagacactatccctctcccctgctttctttttctgttatcaccataattaatgttttacttatatatgatttgttaatgtatgtctcttcccactagaaaccgaattctatgacagcaagggtttttgttttcattattgtcatattacctgtgcctggcatgtgataagccctaagtacttgttgactgaattaacatatgagatctgtgagtctgaaaaaagaagtacatcattccttcacatgtcattttgagccactgttaacagattacataactgttattggaagtgcctcactactccatttggaaagtattcctggaatacacgatgaatgactcagtagaagttctggctatgggggagtgccatcaataaataaaaataataccattgcctgttggttataagttgctgtcacagactatgaaggtatttgaattgtattttcaggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaacc

SEQ ID NO: 646 - DNA, 2459 bp, Homo sapiens
cttttccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagaccgagcctagcagggagaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggtatggcgatatttacccccgtcatatgtggtgttggtggcaatctggtgggcattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccggacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttgaccctttatgtctttaaagatagttaatgcaaccctgaggcttggggtctataaataacaaaagcatctggcattcctctagtgcagtgtttctcaaagtggccttcagcctagaaacgtcagtgtcaccaggaaacttgttagaagtgcaaattattatccctcaccccctggcctgactagccaaatcagcatttcttgggagtagagccagctatatgggttccacaagccctccaggtttctcatacacacccacgtttgagaactactactcgagaacatcatctttaaaaaatgtatgatc

SEQ ID NO: 647 - DNA, 3517 bp, Homo sapiens
atttcttagggaactgccataagtgttttacacggtggctgcaccattttacattcccactgaaggttccagttttgccacatccttgccaacacctgtttttaataattgccatcctaatgagtgtgaagtggtatcctgctgagattttgatttgcatttccgtaatgactggtgatgctgagtatctgtttgttggccgtttatatgtcgtctttggagaaatgtctatttgggctctttgtccatttttcaatcaggtgtgtgtttttatatgttctgggtattcacccttttcagatatatcattttaaaatactttgtcccattccgtggattgcctttcactctgttttgttctttgatgtacagaagttgtttctttcttttagttacctgtgtgtgcctctggtgtcatatctaagaaatcactgcctcacccttttcagatatatcattttaaaatactttgtcccattccgtggattgcctttcactctgttttgttctttgatgtacagaagttgtttctttcttttagttacctgtgtgtgcctctggtgtcatatctaagaaatcactgccaaatccaatgttgttaaaagtttcccttatgtttctcctaaatgttttagttttagctcttagtttaggcctttgatctattttaatttttatatatggtgtgaggtagatctagcttcatgtggatgtccacttgtctagcaccatttgttgaaaagactgtcctttctcccttgaatggtcttggcaccatcaaaaatcatttgacccatatgtgcaagggtttatttggggatttgctattctgttccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatactgatgtgtggtgtttttttcttatagtgtctttgtctggttttggtatcagaataatgctggcctcatagaatgcatttggaagtgtcctttcctcttcagttttttggaagagtttgaggagaattgatttaattcttcagatgtttgccagaattcccatatggccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcagttgtaatgtctcctcctggtttttagttgtttttcttagtcactcttagctatcaacaaactcttggtttcatttatttttctctattgcttttctgttctctattttgtctctgctctaatctttattattattataatcatctccattctgctggctttgggttgattgctcttctttttctagttctttcagatgtaaatttagggttgacttgagatcttaatttgtttaataggtgtatttacagttacaaatttccctcctaccactgctttgactgtacctgtttttttgtatattacatttaagttttcatttaccacaagatattttctaatttcccttgtgagttccccattaatctgctggttgagagcgttgtttaattttcacataattgtgtacttttcagttttttgtctgttactgatttctagtttcatcccactgtggccagaaaagatattttatttcctcagtcttttgaaatttgttgacttgtttagtcatctaacatactgtctatcctagagaaaggtccatttgcacttgagaaaaacgtgtgtactgctgttgtgtctgttaggtccagctggtatgatgctgttcaagttctgtcttgcgactgatcttctgtctggttgtcctatccgttactgaaagtgggctactgcagtctcctactcttactgtagaactatccatttcttcctttgattctgtcaatgtttgtttcatatattttgggctctgatgtttggtgcatatatattacatcttggtgaattttcaaactttttaaatttcaacatgaagatgaaattataggatgtctgggatttcctttgaatccgtggggctgggagtaactataaatgaaacaagattggccgggaatttgaggctgcaaggataggtacacacaggggagtgaagcagggcttggagcagatggtaaagattgttggcttttccagccatggggctctcttgccacttggcagtagtggcatgaagccgccaccagggggccacgcaccagtgcatgtggctgtgttccaaactttttggacaataaaatctgaatttcacatacttttcttatgtcattagatattacccttttacatcttttcactatttaaaaatgtaaaaatcattcttaacatttgcgctgtgcaaaaacagctggtgggcccaattttggcctgtatttcacttgccaacccgatttatacttttgtatctatttgacattttccattaaaagttatataacact

SEQ ID NO: 648 - DNA, 2408 bp, Homo sapiens
attgttgttttaccttccttaatataaggtcatatactcataggacatctttatatcagctttacttttccacatttattctcctctctgtgttaagcattaggtcatttttgtatttactagtctgtgaatcaggaggaaatctgggcgatgagtgagagactactgcgtcactgtctatccttgaaaacctcttttctcacattcagctaaatgcaaacccacactgagaggctgataaaaatccactcttacccttaagttagacgatagtgttctgtgatttcattctggttctactgcctgtggcatgctcccacttaccctggtctgttcacttcttcattcatttgtttacttacctgttcatttcttcatttatccactgactcgtttattcactcattcacttattcactcattcatccatttttctattcgattgacccatatttctagagagtctcctgcacatcaggtgtgtgtgatgggcatgagggtcccaaaagcaatagggtgcagctgccctcagtcataacactccagccaggtccatcagcaaggggtttgctattatcttcacattggaaattaatgttcttttttggaatctaaagtaatatatgcccatgagctgaagccagccagccagccacctgtttctgtgaatagttttcttggaacacagccacacccctttctgtacacactgtcaatgaccgcttttcggccacaccagtggcattgagtggctgcaacagagacggtgtggcctgccaaaaagctggaaatatgtactgtctagccctttccaggagaagcttgctaacctttgcccgaagctcagaaagcaaaagaaggtctctcatctcacccctggagagtgcctctaaggacttatttatcccttagacaatagatggataacttggtcgatagcatctagatttaaaaaggccacgcaaagggcaatgatacctctcaggggctgtgcagacggtgggagagtgctcagaggcgtcagaaaggcccaggcccatagcagcccagtcttgagcctagtagacctgccagccccaagtcggacaggatggagcccaactcatgtggggaggatggttccggctgagtggctgtaccaggtcagaccccacctggagacggcgtcttttctgtcaggacatcagttatgtgacatcttccccatcctcatgttttttagcatctgccacctccactgcccagcaaaactccgcctcctccccctccaaagacaactcgcaagcagacatcggtggactccgggatcgtgcagtgacgtcgcaaggctctctggaaagagtgtgctgcccctccccatctccatgccctctccttctgtgtcccctgagtctgctgtttacctcattgggcctgtgatgttaacatttcgtgcgactgctttttcttcagaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacattttttttttgagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagac

SEQ ID NO: 649 - DNA, 2680 bp, Homo sapiens
atttattatcatgcattcaactcctcaggtatttaatgacaagctactcatagcttgtctcagagcaccaggaattctgagtcacagtcggggtgtaaagcggggccctgcattcagggagctgagtctgactgggaactggaaaggctcccctacctcccatgaccgtctgtgagcttcacctgtgagtggcaggtgcgcgtggagtcagttcccctccatgcccgcctgcattcctacccggagacctccggccgcggtgggaattgccctgctgttttcattactgcaggtttttcttctgtatttctgaacccctcatatctcagggaaggaaatccagggagaagtatctgttgcgtccccatctgttgcattttctgagtctccacgttaatgaaagagcagccatccagtttcctgcagtgccgagagtcctcgggacctgtcgttgttctaaaggacagaggacactgttcagatgtgacgtctgtcgccatttctgtctcctcttagcaaactttaaagcccggaaaaccttctattttcaaagtcggaaaattagattacagcaaagccataaccctgtatctctcctaaccttgctccctaatcaggaataaaagggaaattatctgaagaattatctaatatgttcttcatcaggagatcataattaaatcataattgccatccggcagcaaaatgtgatgaaattaccagggcaaactattaattacttcaaagatccattttaatcgtaaacagtttaatatacctctataaaaattgccatcaggcaggcgcttaatgagggagctgtgaaggctctgctgtccttggtgactggaggatgttttcacgagatcttcacggttattttccatttccagttccttaggcctggctcttacattctctaatactatggggagtagaaatttctgcgtcctcctgggtggagtgtgtgagtgtgtgcatacatatgtgtttatatgtgtgtgtgtgcactgtgtaggtgatatgcgtgtgtgtgcgtgcatgtgtatgtgtgtatatgtatgagtgtgtgctagtgtgtgcatttgtatatgcatgtgtgtatgcatgggaatgtgtgtatgtgtgtgcatatttataggtgtgtctctgtgcatgtgtatgtgcgtatgcatgtgtgtttatatgagtgcatgtgcattgtgtacataggtacatgtatgtgtgtccatgtgcatgctatatttatgtgtacatgttatgcaatgtgcaggtgtgtatgtgtgtacatatgtacatgtgtgtacatgtgcatgtgtatatatgcaggtatgtatgtatatgtgtacatatgtacatgtgtttatgtctatgtgtgtgcatgtgtgtctgtgtgtgcatgagtatatacatgtgcatgtatatttgtgtacatatgtacatatgtgcgcacatgtgtttgtgtctgtgtgcatgttgtgtgtgtgcaggtgggccgttgctttgtagttttgtgggggctaaacaaaggatgtgcatgatgctgtccatgtgtgcatgtgtatatgtgtgcatgtgtgtttgtgtacgtatgtacatgtatgtgtgtgcatgtgtttgtgtctctctctgtgtgtatgttgtgtgtgtgcattcgcgtgtatatgtgtgcatgtgtgtttgtgtgtgtatgtatgtgtatttgctacgagtggtatcttgaagaaatgggattgtgaggatgaaagggaagagtttgtgttcgcagccacacataaactcacagaatagcttctgatggagcacagtaaattttggaattaggtatgaggaagcatctttggtcattcttagttctttgagatatttttcatttaaatgaaaacgtatgcctttttctagatcttgatgcaaacagttgcatcaaagtggagcttgtgagtaagaatgcagatagaaaatcatgggaattattcacgtggatgacctgattttattctagtcttacttatgaagtcttcttcctgctccacaacgattgaagagacaggaaacaaacttttaaaattacgtaaataaacgggccaaggggaaatacaagaggacaagcaaagacagacacagctttgcactgcactcgtggcttatctcaccatggacgccaaattcaaacctgttggcgactcatcacactggactgacggcacaaaggttcttgggaaatagaatcatgttcagcatcaagtaggaaaaaagtcacaagtacttgcagacaagccaatcaaaattgaaggaaaaatagaatcagcacctagtgtaaattaacttcagaaatatgcagtcaggactgtccttgcggacttgcattctagcttctgagctgaaatttgtgtcattaaactgatatctagatgatgtacatttcttgacttactacaattcaaaaaaaatgaaacaaattacatgaacacagtggctatcatttcccccttgtgaatggcatagtaccagtctatacaattttggatgttgtctttctgttgactgttagttactttagactacaaatctcagaacatttaaataatgatttgttacattactctaaacctaattattttatattcactcacaccatcccctctgttggttctgaaataaactattcaaaggagtgcag

SEQ ID NO: 650 - DNA, 2323 bp, Homo sapiens
gataactcactgccttcgaccagcagtggcttggtttctaatgacagtaagacaagttcctatagccattgttaatctccttggaaaagaaatgaacactgtgtggtttcagaagctcattaatatagcagaagcactctgcttctgtttgaagggaggttttcagatgaatttttctgcgtgttcattgaacagacgtttcctaagctcctccttagtgcctggcactgggaacagaagaaggaagaagagaaagctgtgccctcagggtgttctcaggtccgcactgagcggtggtgaccagagccacccgcctgcctgcgtggccggtgcatcaggatagagcaggagttcacagaggagctttgtcacttcccccaccgctaaatctgttctgtggccccacatcactgagtggtgtcaccatcatccagtcacctgggacaggcagctgggagtcatccttgaagcctcctcacctaggccttcattgcaaacctccatttcctctggatcactgtcaccagcctagtgcaggcaccaccagcttctacccagagagcaggttcctttccatctccttctggtcccagcccagtctctgtgcgaaggccagaccgcagagggctccaggccccgtgacatggagttcagcgtgaccttcaggtgctggagagagttggcaagggctttccatggggaactggctatgccctgctttgcactctggacagttagcttttgggtgctgggcatggatcgaaggggcgcacagccggaagggagagctgtaatcatgcagagatccttcccctttaaagcaggggacaggcgagaaaggagatcgagtcaagaatggtgtttggtgcctttgacctcacacttcaggggtgcctcctgtgtgccgtggatatcattggccagacagggactgatgaagacccagcctttttaaagagtaaacaataaacaaggaaatgaaatgttcatagattgtgatagattgtatcaatgctgcgagggcagtaaatagaatgcggtgatagagtcaatagaggtacctaatttggggaggtgggggtggtcacagataccctctctgaggggtttttgttgatgctgaaactgaaggagcaaggaactggaaagagctggtctctgggtggagggagcagcccttgagctcttcctggagcaggagagaacgtgttgtatacagtaagggaagctccaggtgggagagtgatagggatgggtgtggggagggaggttaggctctgtgtgcagtggagaggctggtgactacctgctgtggaggggcagagctcagggcatccatgcttaagagtcccagttttggtattatatttgccaagaaatagccaaccggcgggcctggaggtgcggggatgcggaaggaaagtagtccttgagagggaatgtggtttctacctgcacacgcacactcacatgcatacccgcctccattacgttgtgctgtggttgtttttgaggcatcagagggtgtgcgtgccgccacatgttgattggggtggcttctgcgttcagcgctgccgcatcccttcacccttccccggcacttcagaattgacacttgagctttgttgtaaatagtgatgtgagtaactgtcattcaccgacatctcccccaacacttaaagtcttagcagctgcatttaactcacgcatatttgtttcattctaacagtggtttctgtcaccctttgctctgcacagttttaaaaatacctttgtagggggcttctaagagcttggagtgcctagtaaatgtttttgaatggttagctacagtgttgggtttatatgctgtaatagtgaatttaattggtaagtaatcgtctttctcgtcacatagcccattaggatgtcaccttttctgtttctactttgcaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaact

SEQ ID NO: 651 - DNA, 3394 bp, Homo sapiens
attttgtgcctgtgattggctcagctctgcgtgtgaagagggaaaaggcttccgtttatttagcataatgatggaccaaaacaaaagaagaaatcatttcactcatgcttaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcgacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgagttggataaggaggttcagcaccttcatgagaatataagtgccctaaccaaagaactggaatttaaggggaaagaaattctcagaatacgaagtgaatctaaccaacagataagattagaagaaatggaagaaaaatatctaatgagagaatcaaaaccagaagatatacagatgattacagaattaaaagccatgcttacagaaagagaccagatcataaagaaactaattcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatc

SEQ ID NO: 652 - DNA, 2299 bp, Homo sapiens
atcggaaacaatttgccaaacctctccactagctctgtcttgattcccccaatgggaattaacaacagatttccttctgagaagatagccatacctgggagtgaagaacaggccactgtatccatgggtaccactgtgagagcagccctcagctgcagtgattctgtagcggtcacagactctctggttgcacacccgaccgtcgcaatgtttactggaaacatgctgacaataaactcttatgatagtcctcccaagttaagtgctgaaagcttggacaaaaattcagggcctcgaaacagggcagataattctggaaaacctcagcaaccaccagggggctttgcaccagcagccataaaccgatcaattccgtgtaaagtcatcgttgaccacagcaccacgctgacctccagtttgtctctgactgtctccgttgaaagctcagaagccagcttggacctgcagggcagaccagtgaggacagaggcatccgtacagcccgtggcgtgtcctcaggtgtctgtgattagcaggcctgagccagttgccaacgaaggtatagatcacagttccactttcattgctgcttcggcagcaaaacaagacagtaaaacattgccggccacctgcacaagtctccgagaattaccccttgttccagataaattaaatgagccgactgctcccagtcataactttgctgagcaggcacgtggcccagctcctttcaaaagtgaagcagacacaacctgtagcaatcagtataacccaagtaaccggatttgctggaatgatgatgggatgaggagcacaggacagcctctggttactcactcgggttcaagtaaacaaaaagaatatctagagcaaagctgtccaaaggctatcaaaactgaacatgccaactacttgaacgtgtcagaacttcatcccaggaatcttgtaacaaatgttgctcttcctgtgaaatctgaacttcacgaagcagacaagggctttagaatggacactgaagacttccctggccctgagctgcctcctccggctgcagagggagcctctagtgtacaacaaacacagaacgtgaaagcttccacctcaagtcccatggaagaggctatttccttggctaccgatgccctgaagagagtccctggtgcagggagctcaggctgtcgtctgtcctctgtggaggctaacaatccgctggtgacgcagttactacagggcaacctgcctttggaaaaagtgttgccacagcccagattgggagccaagcttgaaatcaacaggcttccattgcctcttcaaactacctcagtgggtaaaacagcaccagagagaaacgttgaaattccgcccagctctccaaatccagatggtaagggctacttggcagggactctggcaccactccaaatgagaaagcgagaaaaccaccccaaaaagagagtagctaggactgtaggagaacacactcaagttaaatgtgaaccaggaaaattgttggtggagccagatgttaaaggggtgccttgtgtcatcagttccggcatcagtcagctaggacacagccagccatttaagcaagaatggctaaacaagcactccatgcagaacagaattgttcacagccctgaggtcaaacagcaaaagcggctgctcccctcgtgtagcttccagcagaacctatttcatgttgacaagaatggcggcttccacactgacgctggtacctcacacagacagcagttttaccaaatgcctgtggctgccaggggccccattcctactgcagctctgttacaggcctcttccaagaccccagtggggtgtaatgcatttgccttcaacaggtatcttgaacagaagggattgggagaggttagtctttcctcagcacctcaccagctaaggttagccaacatgttatcccccaatatgcccatgaaagaaggtgatgaggtgggaggcactgcacacacaatgccaaacaaagcactagtacatccgccgccgccaccgcctccccctccccctccacccttggctttgcccccgcctccccccccaccacctccgctacctccacctctccctaatgcagaagtcccatctgatcaaaaacaacctccagttaccatggaaaccactaagagacttagttggccacagtccacgggcatatgtagcaatataaaatcggaacctctttcttttgaggaaggtttaagcagcagctgtgaactgggcatgaaacaagtttcctatgaccacaataaacatgatctgaagc

SEQ ID NO: 653 - DNA, 2353 bp, Homo sapiens
acagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccaggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagagtctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgc

SEQ ID NO: 654 - DNA, 2976 bp, Homo sapiens
agaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgagagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttagtaagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatacgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctatctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggttttttttgtagaaagcacagataagtggtaaatggtctttttctgactttcattatgtggactggatggaggctttcaaactggtaccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagcaaagtaaggcatatggctcagagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatc

SEQ ID NO: 655 - DNA, 2479 bp, Homo sapiens
attctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacgacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgt

SEQ ID NO: 656 - DNA, 2621 bp, Homo sapiens
agttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgccggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcgcatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggaccgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggt

SEQ ID NO: 657 - DNA, 2607 bp, Homo sapiens
tagcaaatatgtgaaagccagccagactctcaatggcatccaaaaacataaactacatagaaaagacatgaaagccagccaggcttggcttcgaatcccagcactttggaaggctgtggcaggagggttgcttgatctcagaagcttgaaactagcctaggcaacatggtgggccctcatctctactgaaaatcagaaaaattatccgggtttggtggtgtgagcctgtagtcccaggaatcagtggatgaggccctaggatgtcataggcctgagaattccatgctgcagtgagctgtgattgtgccactgtactccagcctgggtgaaagagtgagatcctgtgcagaaacaaaagaagaaaaaaagagatatgaaagcctatatattgaagactaccaagtactgcttagagcagttaaagacctttggaatagaaaatgtttcttcttgcatttcaagattgcttttgttttgggaggacacactattttttaggaatatgaagttcttcttaggcattcctgtaaaaaaggccacttcttgataggattgtattgaatctgtgggttgctttgagttgtatttttatcttaaccatgttacaacttccaacccatggacacaagatgtctgtccattgatttaggtcttcctgaatctcctcgagcaatgttctgtagttgtctgtgtacaagtacggcaccttcttgaacaaatttattctcaggcatattattcttacaagtgctattataaatgaaatcattgtgtcaattttcttctcagattgttcattgctaacacaactgattgtttgctgaaagtttgctgaattcacttattaactctagtagtgtgtgtatgtgagtgtgtgtgtgtgtgtgtgtgtgtgtgtgtgtgtctggcctctgtatgcatgtatgtgtgtttgcatctgtaggtattatttgggattttctatgtataggatcacaacatctgcaaattgagatcattttgttttctgttcaaaaatactttttctcatgtttatttttaaaagataatttggccaggtgtagaattgtaggtgacagtttttctttttttaagttctttattgcaaacttcttgtttgtatgagaaatcttatgccatccttatatttagtgctctgtatgtaacatgttctttccctttttattccttttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggggtttaaagttttgatgccaatggtctttttatgttttcaagtcatttgttactgtgtgtttcatttatgttagtttcaacttctattccttctagttcaataatcttctcttctgcaatgtttaatccactgccttcttccacttcagactgtaaatcatactttttatctacagaatttgatatttaaaaaatcttcaacctccccatttaattaaaatacaattatactaactgctctaatgtccttttcttctatgtccaacatgtctgtcaatttcaactagattattagattcttcattatgtgtcatgttttcctgcttctttggctgcttcatattcttttatttttttttttttgcggggggatagagttttgctctcattgcccaggctggagtgcaatggtgtgatctcagctcactgcaacctccacctcccaggtacacaagcgattctcctgtctcagcctcccaagtagctcagattacaggcatgcacaatcatgcctggctaatttttttgtatttagtagatatggggtttcaccatgttagtcaggctggtcgtgaactcctgacctcaggtgatccatctggctgcttgatattctaagatttgatgctggaactttggtgtcaatgctcaaaatgcccaaagacaccactcaacctcagtgtctatgcacacccaagcttttgcagcaggacaggtagagcagagatgagtgtgctacaacatgctggtagagggtacccccaattgtgcttggggatttcctattcctcatggaaaaatgtgtcttccttaatttttcccataagaaccaccctacttcatgccctgtctctctgtccaaacaccaggacagtcctctcaccagtctcaaccacccaatggattgacaaaggtgcaaatatgattcagtggagaaggcattctcttgtcaacaaattgtgtagaaacaacttttttttacacaattttttttttatccccaaaggaaaaaaattcacctgaacctcaatactaactcaaaaactaactcaaaatggattatgcaactaaatataaactataaaactagaaaaagtatagcagaaaatataagacaaaatcttcgtgacacagagttaggtaaagtgttctttattatcaataaacacaaaccattaaagaaaacattgat

SEQ ID NO: 658 - DNA, 2253 bp, Homo sapiens
agacaaggacgcggaagcccagggatgttaaggaactggcctgaggttacccaggtggaaaatgcccgcggtggggttcacacctcattcccctgggcgagcgccgatgccgcctcctccaaagcgccccgaggagcgggcggggtgggcgcaggccagaggcaccgacagctgcgggcggaggctctggagcaggtgggtctcacgcgccgccccggccgcagggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtgagctggcaggtgccaacacgcggtctggcccggtgggagaacagctggccccaggctgggacctaatttcagctaccagcggaccattctgtggcaaaagcacatagtgtctgggcccgagaggacttgctttctggcagtttgtctcaaaaatgttctaatccatggggatccaagggaagatgagatatgggacccatgcagtctaccgtgtgatttcagggtggggtggatttctctcaagctgtttaaccttatcaggaaacaatgtatcttgatgtttaccaacaagagacctggaaagaaattgacatgaagacatctccctgtggtgtctatgatgagaagagccttggccattctgtggccttgttcagcccctggcccaagcacagaaggaacccatttgggtgtcgtctttttttttttttttttttttcatttccctttaacccaatctagactcactggctttttctaagacaactatgcaacaagctagagagaaccacaagagttatcaagggacaggagtttggaaagaacccagctcacaaatcatgtttttgattgaatcttggctattgtccagtccagtgagtctcagctgttgcagttatgcccccgaatccccaggacatctggcaatgtctggagacatttttgattgtcacaactgggagtggggattgctactgaaatctagtgggtagaggccagggatattgctgtatgatcctacagtgcacaggacagccaccacaaggaactatctggccccagatggtaatagtgtcaaagttaagaaacgctagtctagtcctaagggctggtcctgcaccccaggctcttattcactgagcttccttggctctctgtgcccaggccacagcagcaactttcctaacatccaagagctgttcctttcccaggtgaaagccaaaaagactgtgccatctctgggctcaacttgaacactactcttcacctctgatccccaacttcaagggatacacatgagcccaggcagtggccaacctcaggtccacattctcagagggaccctgcttcctacatgagaggaaggccctttccagcctctgggctttcagtacaatcaccataatatccacatctcaggttccacccacttggcatagggaggacacagggtattgtcatttgaccccaactttattctcaccatcatgaccactactattgcttcaagtggaggaggccaaggtgtctactttgtgtatgagctaaagctgagtctgggctctgtaataacctctctgcctcagtacgagagaaggccagaattaagacctactccatctgagcagaaaaacttcctcctggagaggcatatcagccccccaatgaccaagtaaagaccagctcatccagccttagctgaagagagtaagagcactgaaaaagacttaaggaaggccaggtacggtggctcatgcctgtaatcccagcattttgggaggccgaggcgggtggatcacttgaggtcaggagttcaagaccagcttggccaacatggcgaaaccccaaccctactaaaaaatacaaaaattagctgggcctggtggtgcatgctggtagtcccagctacttgggaggctgaggaaggagaattgtttgaacccaggaggtggaggttgcagtgagctgagattgcaccactgtactccagcaacctgggcaacagagcaagac

SEQ ID NO: 659 - DNA, 2397 bp, Homo sapiens
atagccctgctgtaactttacactagcaaacaaattctaaactaatggaaccatctctagttataatgaaaaattactagggttcattttagtgttaaaattccaactgtaattaacatttgctttgtttaacaaatgcttaaaaaaaaaaaaaggtaaagaaatactttagttagtttaattatgttgtggccaggatttacagctttgcccagatcctggctagaattccaaggaaccatgttgatcagaaacggcccccaagggtgcttcctgccatgttcccattcattaccatttcattgtcagtgtttggtaatattaattagagtcttcatatatctctggaagaattcgtaattaagaaggaaatgtttactttctaagtcactcatttgaaaaacaaaggaggaataatgtataaccactgaaagccagtcagggatttttttaagtacatttgaaactaccctgacttcaagcagcataaacttgaagagcaggaataaatttccctcacaatgcagtttcttcatttagagaaagcataaattatataaggaagaagcaaaaggctttagaagctcataagaaattataggtatttctaaaataaggggtaacaaataaaagaagcaagctaggacttgccatgcaagatggttaagaagaacaggggtccccttagaaaatagttgttctcaatcccaagaaatgatacagaagtaaatttgaaatttcttttgtagatttagaaaaatcgaacatttgaaaaaataggaagtagaaagcacagggcagaaaccttcagatatccatgagaaatgagcacattttatccacagaaataaaatgtttatgctattgttcactactgaaatgatgttcagttgggccagttgaacatagttgtttttgatagtgaaaggccaataataaaaatttgcatctgaattacgtttaggtaaaatagatgaattctatttcataaataataaaaagtagagtttgccacttttaaaaatatcctgtctcatgtggcaagcatttgttgttgtgattgtctcttgaaatgctttctgaaagagtgcatgattcaccctgatagtgaaaaccttttgtatatttgagttatctaaactgagttgaaatagaaggatgtgatggtttgaaattctttaggactgagaggatatttggactattggaagaaaagctcagagtctactgtaagattaatatgtaagaatctcaaaaccttttagggaaggaaaatgcagttaagtgctagaagcagggttcctgatctatttgaatccagccaaagaatcctcagaaatttgtaattgatttgctcaagtatgaaatgtagatctgagttggcaaactttccgtaaagggccaagtggtaaatatttttggctttgtaggacattggtctctgtcacaagtactttcaaaaacaggtggcaagctgcattggctcacaggccagagtttgctgacccctgatctacattgtttttccttctaaatattgcctgattatcttagcttcttggcaaacatgctaggccggatggagcagaggtttctgttacatgctgtagtctcttattaatgaatcaatccaagaacacgttagagaatctgaagtcaacacatacagatttcatatattttaactttataatttatatttcttgtcagagtgctcccaacttgctgtaaatattttcgcttttgaaagttccaacaaagactgtgaagtaagacagattcaaaatcatatcttcattccttgtatttaacaggtactaccaaactttacttttaatactatcacaaattggaaagcaaatccttgcatatcgtagggcttaattttttattggaggaataataacatgcagactgatgcagtttgaaacattttcttcccatgtgtgtgtctatgtttgtgtcagtccctgtgtctacatgtgtgtacgtctgtgtgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaac

SEQ ID NO: 660 - DNA, 2088 bp, Homo sapiens
ctttcagatgctggagtggcagagccagcaggcgagcagagtttcaaggagcgggccggctgagggagagaagctgctgggactgaggttcccgaaagtgacgggtcagccccgaccctgagcggcagctaggcccagcgcgcgcacgaaggggcgggggccgcgtaccaggctgtccctgcaggcgctccgtactcgtccgagcccacgagcaagaaaaccgtcacacccctcagcacgcgacttccttccgggccgtcgcttcgatgacgccatcaattcacgcgagaagaccacacccccgccccgcgctcgctctgcgccccgcccctcgcgctcccagcggtcaatggccgtagctggccgccagggatcgcccgcgacttggtcggtgcggtcctggacctcggtcttgggtatccgtcctggggctggggatgagggcggtgttggtgggagctccccgagagcgagcggcaggacgcgcatgccccggagtactgagacccagggcgaacctttccaaggcgttgactttggggattgctccggatttccttctgcattaggccgaacctggttcgttttggtttttttagagacaaggtctcgctcttttgcccaggctggagtgcagtggcacgatcatagctcactacagcctcgaactcctgggcttaagcgatcctcccacctcaccctgctgagtagctgggaccacaggcgcacgccacgacacttgacaattttatttttagtaaagacagggtcttggtatttctggtctcaaactctggcttcaagcaatcctcctgcctcggcctcccaaactgctgggattacaggcatgagccaccatgcgcggccttttttttttttctctccttgataaggtactggcgagttgcaactgtttgctttcctatagcacagctgaaatgaaacagtcttttcaatgtacagattagcatcattacctcaccaatcaaaaatccctaccttgagttgttctttatatttttctgggagctttggcccttgggatcctgcaacgccacaaagtatattaacaaggaattattattctaattttaatgaacggaatctaagaagttcagcgaggttcaagggtaaaagccaaggaaagtttcctttgtgtttccttaatatcttgagttcactgctttttaaactcctgccacagtgcacaggggctagtgcacttcgtctttctagataaactgtacgttcccgggagagcagagactgactttccttccgcacccccggggcttaggtgcccagtaaaaacagactgaaggcaacgtgggaccaggcccggaatccagagtttgtgtctcctagtctaagggcctcacgttgtcctccacctgccctattcaccagcatcacattggggcatttctaattcagccactgaggttattaatattttgtttgcaggagagaaagagtccacttaattatagccttcagtaaaagaaaaacttttacaccgggaagatggcaagctggtggtgttagacagatttaagactcaggaaaagggaagtgtggttttttccaggcatgcctgcttgggattggcccgtttacctttcctgcgtttgctctgggtgttgggatgtttcagcattacatggtgaaacccatacgagggttacatggtgctgtctgggagctctgtgcccatctccataaatgaaggcctttcatctccctactctgtccctgcatcccccaccccaaacagacacagctggccaatctctcgatcaatcctatcagaacttgagttttttctctccctgttcagtgatataacctcagctgggcatgcttatttaatagtttatttaataattgagtaagaaaaatggaaatattagggttcatcaacccatgaaatgggggctagcctgcagcatcaagtatttaaattacttgtaatttaagaatttcctttaaccaacctctggcaacccgtctcccctccccttcccacaaatatgtatattattatgtgtcaattaaaaataataaaaacacaaaaatttcctcatcatt

SEQ ID NO: 661 - DNA, 2464 bp, Homo sapiens
attctgagggtgttcagtcaacctcccccctacgcccatgcgcctctctttcctttttcgctcctcatttccgagcccattgttggatctcgaggcttgctgggttcgatgaactcgagtcaaccccccgacccccggcacgcatggaacgggcgtgaccgcgcgcagcctcgtctcggagtctgccggcgccgggaagcttctgaagggatgggattcgagtctccgtgcgcgctgcgggcggcggcagagggatctcgcccctccctacaccccaagtgtcctgagggccacgccacaccaggttgcccagcgagggtcgctggctacccatccggggatgggtggggagccctggcggggcctctccggctttacgccctgttgcttcgcctggccggagaatgtgaggaaggggcataaggttactggtgcttcggccacacccatctttctgagcccactggactgggcgcagaggggggattgccatggaaaccacaggtgtccggagaggggatcttggggctggcctcaccccttccctgcggagattggggaccctggggtagggggagccgcgcccagtcggcctcctggaggacacgggaggaagccccgaacccccgcgcctgaggctgtttctgattggcccctggaggccgcagacacgcagataggcggccctgggtgtatttttattaatattatgtccgtactgattaatattatttatcttaaataaatttcacccgtgtccaagttcaccgcgcccccaaaaccgagtctggggcggcagggggaactcctggccaacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcgaggctcctcgcatggctgggcccgccgcgaggggttgcagagcggctcagggatcgattcaagcatcgtctctcctccctcgccccccgacagagctgggcgcggggttccccttccagatggagcgagggtctcggggtggccccggaaaaggggagcccgcggccacggctacgtattgccatctcgcgagcagagatgtcacctcctgcctttggaggaaagggagcccggtggggatgagcgcatttagcccaatgctgggaacaaagcgcactccgcgcttctgcgatttcgctccattttgaaatgtgttggcgctttggtggggccgctgcggtgggcaaggccgggggcgctgttaatggaggaacctcagggggacggtccttcgtaggaaactctatcctggctctgcgcgcgctttaaggaaatggcttccctccaggacctcgagggatgcagcttttgcgcggatgacggtggggtgctgaaccagccggtgcgcctctggaaatgtctgggcacggatcctggggccatcgacgactcctccccattcccagcaggcgggagctcttacattccgagcgagtgacccctctcaccctctggcgctcacacacctgtaactccaaacctccgtctcagaatggtccaggctggaagggatgatgggggctccgacagcgactgcctagctcacccctctgcgtgctcaggctccaggctcagcaggaccaatttgagttctatctgatccccctcggccccttaactgacccatcctacaggagacagggaaatgtctttcctaccgcggttgattctggggtgtcattttgtgttttgtgatggctgcttatatttactgtataagcattgtatttactgtataagcattgtattataattactgtataagctgcttatatttactgtataagcatctccaaatcctccctctacgtaaacaaattaatggataaacagataagtgtatcccctgcccccacccctgctacgcaggtccggagtgactcttgaagctcatacattccttggccaagtttgcttctctaacagatgtttatatagcaataacctggcttggctcttgggttcacctttggacgatttggggaaggggcttgttggctttgctgggttttggatgagtgacagtccatgactgttcctgctggaagggcgtgacttttaagtggtttctaatatcaggcattgctcctccgacaggaacaaaagaaatggatactgcccataaattgttagaaaacttagaatcgctttgattgaggaaaggttagatttattccggttggaaaaagtggcctttctattaaacgtgccctttgaccctcatgcccttggaggtcggtgccagcctgg

SEQ ID NO: 662 - DNA, 2529 bp, Homo sapiens
tatattaacaaagacaatgggagcaacaacttctcttgtcatgttgagctgtctttcgtttttccaaagcctttataaaccagcgtagaccggtgcctgcagtttagcccacagctcagccctcccttgtggctgccaggaagaggtctgggtttctgactaagcctgggctagagcagctgggggctgtgcccagactcattttattgttgactcagggaattctcactgcagtgcatgttttgcatctagtctgtaaagctagctaatgctgcgactatttgattcactttaaattcctccccagggtttgccagggcaggcttcttgaaatctgcatctttggcccagtcaggagggcttcctacttagtgtaaaattttctgcactttgaatgatttttttttccttttcaaattctcccgaagccaatgacgccttggtggcactgttgagctgtgagtggataatggcatgggaagggccagggctgcctgcgatgcccagagcagtgcactcccgcggcagatcatactcgctcctgggatgtttattaaacacctgccacgtgccaggtgccgttctaggtgctggggacccagcactgaacaggagtagagtctccctggtgggccccagcggggggtgtggaatggcaccaggaggtggttgtggctcactgtgccacagcctcagagggaagctggttcaggtcatgttctgccgcatccagtagtttcacaaatgttaggggaccacctggtctgtagctcagacggcccttcctgcccccataggccaagttcaaagggatccaggaatagatctggaatgttccagatccatttccaaggcttcctttagttcagtagctggccggacagcaagtggccccagcagttctcttgtttgcgtttcaggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccctctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagtgtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttgtgcttgcttgcatctttaataaagacatgttcccggcgt

SEQ ID NO: 663 - DNA, 2236 bp, Homo sapiens
gtcatccccgccggcctcgccccgcagccatggccgccggccccgcgccgccccccggccgcccccgggcgcagatgccgcatctgaggaaggtgcgaggcggatggagcgggtggtcgtgggcatgcaggaccccgaccagggcgtgaagatgcggagccagcgcctgctggtcaccgtcattccccacgcggtgacaggcagcgacgtcgtgcagtggttggcccagaggttctgcgtctcggaggaggaccccgtacttctggacaagtaccctgaggccggctgcagagctggactatgccatctacctggccaagaagaacatccgaaaacgggggaccctggtggactatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaagtagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccgtccccacccatagggctggctcacatccagtcactcccaacagcgtccagcacacaaataaaagacccttgggccctggctctgagcccatcctgc

SEQ ID NO: 664 - DNA, 1997 bp, Homo sapiens
agtccgcagccgccgccgccaccgccgcgcctcggcctcggtgcaggcagcggctgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaat

SEQ ID NO: 665 - DNA, 2119 bp, Homo sapiens
cgagtcggccttgttgcctactggtttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatggtgagttagtgctgtggtacagaagcagccaacctgtgcctactcatgtccccagttcctagacttaaggagggaaggggagaaatacacttgaggaaggagagtgggggaggatgtccaaggtgaatggggcagggcactgaaaaaaaaagttgaaggagtcaggggaagcaggaaagagttacagaaggaaaggaggatctcagggaagtctaggaggaaaaatagaatttcgaagaatttcttttagaatgaattgtcgggggggtgctgggcacggtggctcacgcctgtaatcccagcgctttgggaggccaaggcgggcggatcacgagatcaggagatcgagaccattctgactaacacggtgaaaccctatctctactaaaaatac

SEQ ID NO: 666 - DNA, 2496 bp, Homo sapiens
agaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtatttaccaccaaaatgcatgcaggagatcccgcaagagcaaatcaaggagatcaagaaggagcagctttcaggatccccgtggattctgctaagggaaaatgaagtcagcacactttataaaggagaataccacagagctccagtggccataaaagtattcaaaaaactccaggctggcagcattgcaatagtgaggcagactttcaataaggagatcaaaaccatgaagaaattcgaatctcccaacatcctgcgtatatttgggatttgcattgatgaaacagtgactccgcctcaattctccattgtcatggagtactgtgaactcgggaccctgagggagctgttggatagggaaaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagcttgcaggatttgagttgaggaaaacacagacttccatgagtttgggaactacgagagaaaagacagacagagtcaaatctacagcatatctctcacctcaggaactggaagatgtattttatcaatatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggatccctggacaagaagctgggagaggcacaaactggacatctctctctctcatatccttcggcattgggttatctatgggagcaaggagtggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtctt

SEQ ID NO: 667 - DNA, 2004 bp, Homo sapiens
gtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacataggtcagtgtctgagctctttctgaaacccgttctcaacatgtgttcggtgctgaggattctgggctgcacctgggccgcagctcttctcatactgaattcagaaaggtaacgctgggtaagaaaatcggcttccgccagagaagaaagtccagatatctcaggtcctgtgaataacttagtttctctcgcatactctgtttttgagccattgaagcgcaggaatgccaagcaccactcacttttcctcattgtctgagtgggatggaaagagtctcacttgcagttgcttcagtcacaacccaggcgtctgccttaatagcatcacctgtgccgtctgcgtttctagcgtcacctgtgccgtctgcgtttctagcgtcacctgtgccgtctgccttcctagcatgacctgtgccgtctgcctttctagcatgacctgtactgtctgcctttctagcgtcacctgtgccgtctgcctttctagttaaagttgattttaaattaatttgggaaaaacggtgaacaagtggggaaaaacatcaccaaagactccaaacaggtggaacgatgaacttaatgttccctgcaccctccttacagatgcctggactttggcctgtgaatgagccccggggggctgggacagtaggggttttcatggaatggacatggggtagcaggaagtctcagccccagagggcttggcaggagccgccctctctgcggagttcttcccagcgggtgtgcgttggtggctggcggggaccccccacaggaactaggtctcaggctgtggaaagggagctgccccagggcccaggagggccggctctgcattccgcatgttcccagagtgaaagagaatgagaaggagacacacaagtgctgttatgacctgggttgttggttggcaaatacagcatctaatagaaactttcttccatcccagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactgat

SEQ ID NO: 668 - DNA, 2467 bp, Homo sapiens
cttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctagtgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatgggttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacat

SEQ ID NO: 669 - DNA, 2234 bp, Homo sapiens
gttttcggagtgcggagggagttggggccgccggaggagaagagtctccactcctagtttgttctgccgtcgccgcgtcccagggaccccttgtcccgaagcgcacggcagcggggggaacttcagccctccaggcggggtgggttccaggtccgggtccgaggcgggcgctggaggctcggccccaggccggagaggaactcctttcgcgagctgtcgccgtgggcccgcattgtctgcaggaactctccggaatcgggagggggaggactggatcgcgcttccactgggattcgtcaagggttccggcggcagctgcggcggtggcggagactccctttgtcctctcaggacctccctctctccctccctgtcagctggtgggtcccgctgccgcaggcgccggcgtctcagctgctcgccgccccccaccccagagtgcgtgcagggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 670 - DNA, 1818 bp, Homo sapiens
gagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaatcatgaggcagtgaaatccatgtttcatacccagatgagaattgaactgcgggccctaggcaagatctcagaaggagaggagctgactgtgtcctatatcgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctggggagacccctaatgaggaagttgaggtaatgcttaacattgttgctgtgagaatttactgccctgtgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactat

SEQ ID NO: 671 - DNA, 2277 bp, Homo sapiens
actccggctcggcggctctgggcctgcggcgggcgctgcgggttggagctcgggacgtggtcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcagcgcttgccgttctccacggtgtctaagcaggacctggccgcctttgagcgcatcgtgcccggcgaggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcgatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcatgggcaggaccacgtgggccgtgatcgtgggttgccgagaggacctgagcgccgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 672 - DNA, 1953 bp, Homo sapiens
atttaacttgaaaaaattttaaaaaattttatagaggtggggtcttgctatgtagcccaggctggtctcagtctcctgagttcaagtgattctcctaccttggcctccaaagttctaggattccaggtgtggtcactgtgtcctgccaccagagcctcctgagggctgtcctggtgtgattagagggctctgagcagggccagctgtgccatctgtgcttttcctttgtcctgttacctacccttgcactgggccgttagggcactgagatcatccctctccatcctgtcatgctgtgctgtcatctttagtcaagccagaggatatggtgcttcgctgtgtttcacacacagctgttcccattggcttcaaatgggcctgtttagttaaggctttgtgtgaagtatgtgggaagtgggtttcactttcaagaaggcagcatggagctggggcttggcctctgctgtctggtatagaggagcctggggatcaggtgtagctgcagacacagctgggcgcagagggagtggcctcatttcccagccacctactcctgccgtgcctcactcgccggggaatgtgatgtgtaggtcttgagaagaaggcccaggtcctgcagcccggtgaaaagacaactgtggtctaccacgaggccggacacgtggtggtaggctggttcttggagcacgtggaccccctgctgaaggttggtcctcccaccctgagtgagtccacctggcaggcttgggcctggtatctctgggccaacctgtggtcatgtgggcatggtacattcaaggattggccctttagctttttaaggaataaactgctctagaatttgtcaaaagatcccttcggggtgggaaagcagggcagtgggttccaaatggggccttggccatgcgactccagggagcagcctcagtgttaaacccgcctgactcccgagctctggattcgaccgttggcctctccagagactttgcagggtgggcagagcgtaggtggtttccacgtgaagctcccaaaggcgggtgcacttcttggggcatccccatggtgtatggggggcctgggtcaggctgtcttctctcctgttccagtagaaggacctgtggtcagagctagggtcaggtggcctggccgctccagggtggctcctggaggaagtggggacagtgtttggggtgatgagggcatgtgtcctgtcctcaggtgtccatcataccccagggcaaggggctccgctacgcacagtacctgccccgggagcagcagctctacacccaggagcagctcttcgaccgcacgtgcatgatgctcgggggccgggtagccgagcagctgtgctccgggtagatcactatgggggctcaggacgacctgaggaaggtcacccagagtgcctacgcccaggttgtgcagtttggggtgagtgagaagctgggccaggtgtccttcgacttttcccgacacggcaagaccctggtggagaagctgtacggcgaggcaagcgcccagctccttgatgacgaggtccggcacctcgtcagtgccacctacaggtgcaccctggacctgctgacacggtgccgggagcatgtggagaaggtgggccagcggctcctggagaaggaagtactggagaaggcagacatggtggagctgctgggcccccggcccttctcggcgaagtctacctatgaggagtttgtagagggcgtgggcagcctggaggaggacacatcccttcccgaggggctgaagggttggaaccgcggacaggaggaggaagatgtggagagcagcctgtgcagggggctctgtgtagcctgtggcggtcgcctgcacctgctgctgggtggagttggggtgactgccacttacctggggccttggcaaagcagctgcggaatctcacccaaaacaaattaaaacgtgacaactgtg

SEQ ID NO: 673 - DNA, 1925 bp, Homo sapiens
actcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatac

SEQ ID NO: 674 - DNA, 1816 bp, Homo sapiens
ctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcaggggaacaggaacctgataaagaatcaggagcctcagtggatgaagtagcaagacagttggaaagatcagcattggaagataaagaaagagatgaagatgatgaagcaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaaggatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctctccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctg

SEQ ID NO: 675 - DNA, 3082 bp, Homo sapiens
tttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatgcaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccgagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccgagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcggatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttact

SEQ ID NO: 676 - DNA, 3209 bp, Homo sapiens
gacttccttgtttggagtaaacttcggcaacatctcatggctgaggggtttgcctttccatctgttgatgtgctttctggaagctccccggtctgccagagaaaacatatctagaagacgcacgacgccaattcagccattcccttgggtccccaaatccccccagccaccagagacggaaggagaaggtgaagtggaaaacagacgttcctgtggcgcgcgggatccgcggctgacagagagtagcgtggccaggcagggatctccgcgcccaccggtcagccccgtccacgcgctcgggcgcgcgtcctcccttcctgacactcctctcgccgcctctggaactcggcttggagatggggcagtcgcgacggctcctgcctcccccgagctcctagcgctttagctgttgacattgggtccccgctgttgtctccaggcgctcagctgccagcgcgcggcggggctgagagtgacagcgcggcgcggccgggggaggattcgccgccgagccccgggctgctcactccgccgtgggggggaccgcagacgccgctggtctcgctgcgaggcccctgcccggccggccgagccatgacggacgtcggcaacaggaaggagggcttcaaaaaatgccggagcgccactttcagcatcgatggctacagcttcaccatagttgcaaatgaagctggagacaagaatgccagaccactggcccgcttctctcggtctaagtcacagaactgtctgtggaactccctcatcgatgggctcacagggaatgtcaaggagaagccaaggccaacaattgtccatgaccctcgacccccagaggagatcctagctgatgaattgccacagctggatagcccagaagtcttggtgaagacatccttcagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagcccctgttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagctgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaactt

SEQ ID NO: 677 - DNA, 1623 bp, Homo sapiens
gagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctc

SEQ ID NO: 678 - DNA, 1783 bp, Homo sapiens
actcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 679 - DNA, 2321 bp, Homo sapiens
acatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtgtgagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggttgttcctactgaaggattggtctccatattaaagaagaggaatgatactgtaggagatcatcctgcccaaatgcaacacaaaccatctaagcgaagagtgagattccaagaaatagacgatagcttggatcaagatgaagttggaggtggctcctgtattttgctggtcttgctgtgcatagcaacggttttcctcagtgttggaggaactgcattatactgcactctcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagttcgtgtgtaatcagaaggagttaccttatggtttcagtgtcattctttagttaacttgggagctgtgtaatttaggctttgcgtattatttcacttctgttctccacttatgaagtgattgtgtgttcgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtagaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcgaaaattcaatcataccttccatagacaaatgtctgatttttgtttaaatctgtccgttaggtggcctttccttatctgaggtgtagtggtctaacatttaggaagccttgctttgactttatcgggcagcatt

SEQ ID NO: 680 - DNA, 2708 bp, Homo sapiens
gaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagcgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagtaaaaattatgcggtctgttaagaaaaatgagtaatttgtgttttggacttgaaataaacagtgttctgt

SEQ ID NO: 681 - DNA, 2637 bp, Homo sapiens
agtctcgagctcccgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaaggcagttaccacacctggcaagaagggagccacaccaggcaaagcattggtagcaactcctggtaagaagggtgctgccatcccagccaagggggcaaagaatggcaagaatgccaagaaggaagacagtgatgaagaggaagatgatgacagcgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcccgtgaaagccaagaacgtggctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgacgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgggggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccag

SEQ ID NO: 682 - DNA, 2308 bp, Homo sapiens
ttttatacctattaaccatccccacttcccccataactactcctcgctactacttttcccagcctctggtaaccatccttctacacgtttttggttgtttgagatggggtcttgctctgttgcctaggctggagtgcagtggggccatcatggctcactgcaacctctacctcccaagctcaagcaatcctcccgcctcagcctctcaagtagcttcagattgttcactgttggcatataaaaatgttactgatttttgtatgttaatattgtatcctgcaactttactgaatttatttctcagttctaatacttttttggtggagtctttaggtatttccagatataagatcatattatatgcaaaccaggataatttgacttcttcctttccttcccaatatagatgccctttatttcttttttttttttttttttttggacttattgctctagctgggacttcgagtactgtgctgaacaacagtggtaaaagtgggcattcttattgtgttccagatcttacaggaaaggctttcagtttttcctcattcattatcatgctagctgtgggtctgccatatatggcttttattatgttaaggtagctgcttctatacccagtttttttttagggtttttatcatgaagggatgttaaatattatcaaaagctttttcagtgcacattgaaatgattatatggtgtttgccctttattctgttgaaatgatacatcacattgattgatttgcatatattgaaccatccttgcatcccagggataaagcccacttggtcatgatgaatgatctttttggtgtattgttaaattcagtttgctagtattgagttgaggatttttgcatcaatattcatcagtgacactggcctatagttttctttttctgacatgtctttgtctggttttggtgtcaaagtaatattggctttgtaaaataagtttggaagtattgccttctcctctgttttggaatagtttgagtaggattggtattagttcttttttaaatgttactagaattcagcagtgaagccactgggttctggggttttctttgctagcagactttttattatggctttgatctcattatttgttattggtctgttcaggttttttatttcttcatggttcaatgttgctatgttctatctgcctaggaatttatcaatttcttctaggttttccaatttattggcatatagttgttcttagttgcattaatgatcctttgaatttctgcagtatcaactgtaatgtctcctttttcatctctaattttatttatttgggcctttctgtttttttcttagtctacctcaaggtttgtcagttttgtttgtcttttcaaaaaaccaactttttgtttcattgttcttttctattgtttcttcatttcaaattcatttatttctactctgatttttattatttcttttctactaattttgggtttggtttgctcttgcttttctaattctttaaaatgcattcttaggttgtttatttgaaggttttcttcttcttcttcttcttctttttttttttgatgtgagttttacttcactcttgcagcctaggctggagtgcaatggcgcaatctcagctcactgccacctctgcctcctgggttcaagcaattctcctgcctcagcctcccaggtagctgagattacaggcacccaccaccatgtctggttaattttttgtatttttagtagacagggttccaccatgttggccaggctggtcttgaactcctaagctcaggtgatccactcacctcggcctcccaaagtgctgggattacaggtgggagccaccgcacccagcctgcaggtcttcttcttttttgatgtaggtgcttatatctataaacttccctcttagtactgcttttgctgtattccataggttttggtatgttgcattttcattatcatttgtttcaagcaactttacaatttccttcttaatttctccactgaccaattggtcattcagaagcagattatttaatttccatatgtttgtatggtttccagaattcctcttgtcattgatttctagtttattccatgtattctatgacacaatttaaattatttcaatttttttggagagttttaagacatgctttttgaactaacatatggtctatccttgagaatgatgcatgtgctcgggaaaaatatgtgtattctgtagctgttggataaaatgttctgtaaatatctattagatccatttgatctatagtgtagattaaatcccatttaatttt

SEQ ID NO: 683 - DNA, 2628 bp, Homo sapiens
aggaaccagactgtgaacaagtttaccatttagtcctttggactgtgtcttgaattcatccctcttctccattctcaccagcaccatcatcatgatggctaatatttcctgagcacctttcattcaggcatgatgccaggtgcaccaacttacttaatcctcatagccaccacctgagcaagctcctgttttataaatggaccagttcttgttgctgttgtacaagttattttctttctataacgtcctccttgtcctccttccacattcttaaagaaactttcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctcccattatgggaaggatacatgctcctactagtaaatttagttggtagaaaaaaattatcactatctagactgctttccctttagtctttatgcatagctttctgtctgcctatttttactttgtgtttgtaacttactattataaaatatgcatctctatgttcattgtcaacattatttacaataacatggagtggatttacatgtattctctatatttggattaaaggagatagagtatgtgaaattaaatgggagaagtatctgatacataacaggcagtacaaatattatcacatagcgtcaatttatttgtgaatattgaaagctccaaaaaagaaaaaaagtttttttttaattcccgtaattacttattgcagtattgtgttcatacaaactgctcagtcattttggagaaataacaatttttttcctcatcatgaagtaaggtatgctcactgcaaaaaaaatctagaaaataaagaggaacatgctaaagaaaagaatactcccatataatctctgtcttcataaataatcttttgtaacgcttatacactgctggtgggaatgtaaattagttcagccattgtgaaaagtagcgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggagtcaacctatatgcccatcaatagtagactgaataaagaaaatatggtacatattcaccacagaatactaagcagccataaaaaagaaaaagatcatgtcctttgcggcaatatggatggagctagaggccattatcctaagcaaactaatgcagaaacagaagaccagatactgcatgctctcacttataagtgggagatacaccatgagaacacatgaacacaaaaagcggaaaaagagacaccatggcctacttgagggtggaggctgggaggagggagagaatcaaaaaacttcctatggagtactatgcttattacctgcgtgatgaaataatcactttgaacattgtcagtacattatcttctaatctagactcttttctatgttctatatgcacacagaaatacacatgcaaagctgaacacatatgtgaaacaaaattcagacactcaaattttccgccaatacatgataaaatcttgcacaatagcttcctccacagaggaaaatgtctttactacatcttaaaaatggggtaaatgaatagttaggctcttcagtgtaataatcatggtaaatattctcaatgtgcgaaaatacaaacaaaagactttctctcccagcaaatttagacccacatgaaaatttaagcacaatcattttaaacgaatttaccctggagcttagtggttcgagctcaaggttgaggagcagtctggggacatcagctcttaatatttttcaagttttggagcaagtggtttctaggttctgagtgaagtgaaacagaatctctaggggcatgtagtaaagataatcccatactatgtactgcgtagagttaaagagaagaggcgagagcatgaagataaaccagtacaatcagtcgttcacataccactaactacaatgatactcccgtttgcttcctgtgaagtagttactaataatcactgatgtcgctttttaatttcatacatcctttaactatcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctgagaaaagaagcctttggtattttaaagaattgggaagctatttcagataagctatcatatgcatgaagattaatttattcatatgaaatgttcaataaccagaaaagactgttttaaataaaaccatttcacaatt

SEQ ID NO: 684 - DNA, 2639 bp, Homo sapiens
acaccggcccttcgggagcgtctgaggaggcgcgggccgctgcgggctcgggcgccgcaccgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtggggaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaataaaaggaaatttacaaagtgttggacttacacttcgtcttgtccagtcaactgatgggtatgctgggcacgtcatcattgaaactgtggctccaaactcgcctgctgcaattgcagatcttcagcggggagatcgacttattgccattggaggtgtgaaaatcacatcaacactgcaagtgttgaagcttatcaagcaggctggtgaccgagtcctggtgtactatgaaaggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacctcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgt

SEQ ID NO: 685 - DNA, 2382 bp, Homo sapiens
gcttcccggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgccctcagtggtcaggcgtgcaattttggtctgcgccacataaccattctgaagcttttaggctttggagaggaagttgggggagtgttagaactgttcccaattaatgggagctctgttgttgagcgagaagacgtaccagcccatttggtgaaagacattcgtaactattttcaagtgagcccggtgtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacct

SEQ ID NO: 686 - DNA, 2344 bp, Homo sapiens
cagctagaagataattttgatggtgcctaaatcctgtaatcccaacacactgggaggatcagttgaagccaggagttcaagaacagcctgggcaacagtgagatttcatcgttacaaaaaaatttaaaaattagccaggtgtgggtagtgcacatctgtaatcacagctactcaggaggctgagacgggagaagcgcttgaaccagggaggtggaggttgcagtgagctgagatggcgccactgcactccagcctgggtgacagagcgagactccgtctcaaaaaaaaaaaaaggccgcgcgtggtggtgggcgccctgtaatcccagctactacttcggaagctaaagcacgagaatcgcttcaacctgggagatggaggttgcagtgagctgggatcacaccagtgcactcctgtctgggctgtagagtgagactctcaaaacaaaacatcactctggcagcactgtagagaatgaactggtaggggcaagactatttggagacttgcaataatatttcaggcaaaatacgaggaaggcttaaactagggcaatgaatgaaggctggagagaacatgggtttgaggaagtttaaggagatagcatctgcatacttggttgccatttgagtgaagtgaaaggagaagtggtatcgaaaatgttatttggtgtgtttcgcttggagataattaattcgaagtgatgcctgctgtaacaggtgtgcatagtgctgtagaggatgcttacagttcagcttagggctggttggaagtaacatgtgggtcctgaagtcattcggtctgggggtcattgtcctaaacagagaagataggaaggaataggagctgagcatttagaggtattcttctttgtggtttaatattatacccatgggtcatcctcaaaagatgtgcccttatttccccggggactttcggaaacccggctacgaccccgcggaacgttccgaggggaagcttctctaggccaccagagggcgccaggcgggccgcagcgactccagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccaggtcggcagaagggggccccagagcgggggcagtgaagggccaaagatggggactgaaatcgggtgggaactggcggcgaggaccccgcccccaacgcgcggtgtagccccatttttggaagtcacgcccacccagtgccgcccttctgaagccttaacccagctggcttccttctgccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggtgagtattctggggacaaggccccaagtacagagaagaaatttgccctttccccgcaacaatgtttttcccagtctcagaaggataaagtgggccccaaaatgtggcatgttcatagtcacaagggactgcaactccctctgtgtccactggaggggagaggagtgtcaacagtgagtgggggctccctggccaagaccaccaccattcacctactggccccactgttgttgcaggtgggcacgtggaacttgaggaggaggtaaccagtcagctgatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaacttttg

SEQ ID NO: 687 - DNA, 2144 bp, Homo sapiens
tcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcagggttcaagcgattctcctgcctcatcctcccaagtagctgggattacaggtgcccgccaccacacctggctgagttttgtatgatactataaacttaataaccacagtttgagagctgtaagcaagcctgtgtcaacattgctgccatgtggagacactctgaccaagaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatgtgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattac

SEQ ID NO: 688 - DNA, 2100 bp, Homo sapiens
acacaatttcactcctctgcattcaccaaatgtccaattacatatcctccctgcctggaccttcagaacaatataaaactgaatgaaggctatgaaagaagtcacaggaggatttttgcagagcttccatccagttcagaaacaaagcaattcaatacatgtcttcaagatttctaaaggcaatgacttattgttgttgtttgtttgttttgtcagtagaaccatggagaattgccaagattgctgactagatgtggctaggagaaatatctcccactgagagactgggacattggaaagactataacacacctctgagtagatcttctgatggaagacattaagagtggatgcagagaggatgcagatgctgggctgaagagagaggaagctggaaaccctgcatagtgtggctgagcctcaggacttgtacctggccctcagagactcctgggggaagggtgagtttacaggtgaggagtggcctgctctcaccatggacccattctggtaggtccctcaacctctatgggcatctgagatggtaggaaaagctgctcagagaggtcatatgggcaggactccagcctatgcagagcccagagtggtgggagaacagctgcagtgaagcacatccagggacggccatcctccaaggctcactgtgcttctccaggatactttagcctcaatatgactgttagagctagacaaagcagggcagtcttgctcatgggatgcggcctgatgcctgatctgatgctctgttacctgctggcctctcttggggagccagtctggtcgtgcttgcttgaagtgcagccttggatacccaacaggggtgcttctaggaaccctcatcatagctccttcaatggcagacttagctccttcaatggcagactgtgcctgattatcagagaactccagcagaccaggccccacttacatgaaccagcccacgcacagcttcaccctatcacagccctcccgtaatgctttactgacatgcatttgctcatggccattctccatcgctgtgcttgtatgagtccaccttgttgcttccccctgccattaacatgcaggttcactcctgtgccagcactaatgtgtgcacagatgctggcaacactgttctccccccaacccctgctaccaccgccaccaatgctgccggtgtgaatgcatacatggacaccagcaactccatctctgctagtgtactgcccttgctgtgctgtcatcactggcataaacatgtgcaggaacaccacctccctgctcccacagttgctctgtgcaagccaacatgtgtgcaccttgccacattgctgtggctgctggtatgcatgagccagcatggatcccactgccactactccagtgacatgctttgaccagcacccttccccatcagagtgtggtggccagtggacaagaacacctcagtctctccagtgcagcagcttcctaaccttgaggggccagagaacaaggctgggggcccagtaccagcctcccagagttaaaacatgcagcccagcagtgtagagctgagccttggctttctaaaatcttccagaaataaatgaagccagttgactgaacccatcatatgccacaatctaactcccagggcatcaaagaagataaaagccaaaatccccatccaaaggacagtaatatcaaagatgagaaagaaccagtgcaaaaaactctggcaattcaaaaagccagagtgtctttttacctccaaacgatcactccatttcctcagtggtggttcttaactaggctgaaaagacagaaatgacagatatagacttcagaatatggataggaaagatgatcaagatttgggagaagattgaaacccaatcctaggaagctaaggaatacaataatgcaatacaggagctgaaagatgaaatggccattttaagaaagaaccaaactgatgtgatagagtgacagagctgaaaaactcactttgagaatttcacaatacaattgcaagtattaacagcagagtagaccatgctgacgaaggactctcagatcttgaagaccagttctccaaagttaacttggtcagac

SEQ ID NO: 689 - DNA, 2867 bp, Homo sapiens
ttgcctgaagaagtgtggggagggtggggaaggggtggttggctctccagccccagagtgctctgtggccctgggagggcatgggtggcacctgagccaggctcccacggttccgcctgcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctggtaagaaggtcctcatggcctgtctgtggtccctgaatccctctgccctggtggccttgggcaagtcatgactcctgctgggcctgtttccccacccgtaaaacaaagaagttgagcgtctgatgttaggctctctcgatggtccatgctctcagcttcccccaccccactttcctcaccggagccgggctccccatgcctcgctctgcccacagggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttttaacagtgttttgtagatttcagatgactatgcagaggcctgggggacccctggatctgggccgggcctggggctccgaaattccaaggcccagacttgcggggggtggggggtatccagaattggttgtaaatactttgcatattgtctgattaaacacaaacagacctc

SEQ ID NO: 690 - DNA, 1993 bp, Homo sapiens
attgctgatttggtaaccacctcagagcctaccctatttattcccagcatggacctaaatccacttcagccaaaaatgaacaaagaaatgatgaggaacagagcctgtttctttctcagtggtgtactcagaaaatggatgcaagagtagaagctgatcctcgaggcttgcaaaagtggggttctttctgaaagtgaagccagcagccaagagccacccttcagaagatagaaggaagagcagctgcatgagtgatggccacagcaatgcatgggtcctgtctgtccacgtagtcctctccatctgcccgtagcttgccaggtctcctacccacactggggaaattccagctgccggccctctttgggttgcacctcccctttttgcacagggccctattgggaaagcagctgtcatgtgtctatttgaaagacaagaaaccagtctagttatagaaaagagatttagattacatcagaataacaatgcaaatcatttgtgcagttcttagtacagaaaacagatttaggaacaaaaattgggagggttaaagaaagtggttttttattctgtcatcaaaattgttttttaaaaacacatctgtagtaagataaataattgtgtgccgacttcataaacagaatgaatgactgaattcacacaatgttatttactgtttcagggcacacacacatggtttccaagtggtttcttgccactttggccttcaactggccttgctattttccattgaggggtgtctgattgtctcctccacagccctgagtctaagcaaaagcccatgggttggttgactggtgttcttgttgtccttggaagtggacagactggcagatgtggggctagtggggaagattctcgtaaacactttatttgttgtaagaactccagttggaatgtggcttccaatcatgggaggaggactgctttagaacaggaaactttctataataataccaatacaaccaaagactattattctgaacagaaaacgagaaatacagctggagctatttcctatctacctgatgaagggcactaccaggcggtcactctggctctgtccaccgatgcctgtgcccactttgtgcgacgtagcttccatggagacaagagcaatggtaatggaagaagaaagtctggatgtactcttgcagaagcagaaagcttcatggaacaatattaatcttctggtcatctctgtgctggtctagttgcccataaagttgtcagattgactttggatttaaagcctgaaaatgagtcccaaggaaatccgttgacatgaggcccaaggaagacagtttttggaaggggcaaggagggacagttctctgctccactgaagctaggtatggccatgtgacccatgttgccagtgaaacaggaggagaagggacatctgggtggaaacatttaagagtcaagtgtatttctccatactctctttctttggctttggcagtgatgaaggtcaatccaattacagttgattcttgaacaacagaggtttgaactgtgtgggtcaacctatacgtggattttcttctgcctctgccacctctgagacagcaagaccaatccttccttttcctccttctcctcagcctatacaatgtaaaaatgacaaggatgaagacctttatgatgattcacgtccacttaatgaacaacgtacctttcacttcccaccatgattctgaggcctcccgagccatgtggaactgtaagtgcaattaaacctctttttcttcccagtcttgggtatgtctttatcagcagtgtgaaaatggactaatacagtaaataggtaccagtagagtggggcattgctgaaaagatatctgaaaatgtggaagcaacttttgaactgggtaacaggcagaggttggaagagtttggagggctcagaagaagacaggaaaatgtgggaaagtttggaacttctagagatttgttgaatggctttgac

SEQ ID NO: 691 - DNA, 2222 bp, Homo sapiens
gtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatc

SEQ ID NO: 692 - DNA, 2642 bp, Homo sapiens
acattttagcagagttcatgcctttcccacaactctaatcttgtagcccttcattaatcttacaaaggcggttttcagtccctgagcaaggaggggtttatttttgggagggactattatcatcctttatttcaggttaaactataaactagattcctgccaaagttggcttggtctacgtccaggaatgacaaggacagctgggagggcagaagcaagatggagtcaattatgtccaatttatcttactgtcataatttttcaaaggcagtttcaaggttactattctcatgattcaacacatcctcaaggagtgagattcagtctgtgtaagtgtatcatgactttctataacacgccttgtcatgcactcttctaccctgctagaattggagtctggcctcagctggttcctaccagcagtactgccatcacctcatcctcatctgccccatctgttgttttggaaccacttgtgtcctctgaaatgcatatgttgaagtcctaaccacctgtgcctcagaatgggactatgtttggagaaagggttttaaagaggtacttaaagttaaatgagatcattactgtgaaccctgatccaaattgacttatgcccttataagaaaaggaaatttggccacttacactcacagaggaagaaatcatttgaagacacagagagaagagggccgaggagagaggtctcagagaaaccaacccaatgacatttcgtcttggatttccagcccccagaattactggaaaatacatttttcttgtttaggccacccaatctgtactactttgttatggcaaccctggcaaactaatgcagtcaccaacccagggtgaaaatgggacattcccaactctagctcttaggccaagcttatttgtaatagattcttgttttcaaaggatatagatattgagattctcaatgtatttgttaaaatacattgtttcttgttaaaagcataagactttgaaatgtctctgtgttgcagatatgtagatgttctgagccataatttttggaaaattctttcaaagaaaaggaaatctactggacaaatagcatgattaatggggatctagtgacaaaataatctgccctaattggatttgtgatgtttttgcaacttgaaattagcttcaaaatccaacaataatacgaaagaatgttcagtatcacgaatcaaattaaaaccataattaaatcacctcctttcattagggtagctactataaaaaaaaagtaaaacaaaacagaaaatagcaactgtcggcaaagatgtggagaaattggaacccttgtgaaaccatcccacagtgttgacaagaattgcatgctgggttctggacagaaatagttccaattaagtactaatcagtctgcacttgggcccacttactcgttgttaaaagtcatgtagccctggatgctgaccatgtacatctgcattgttcctatagataagatctctgacattagaatcataaggcttttgtttaaggatcacttatgatgtttttcacaccccaaattccagcagccagtttgaagactcccacagagtaatgggatcaatatgagaatacagcttcttcatctccctatctcatgacttcaccctctactcttccaaccaatcagtgatctccacattgcagcccattccaacactcttaaaaacccctacccccaaatgcctcagggagacagatttgaggtttcttctcatctcatttagtgaccctatgattaaacccctttccttgctacaacctggtgtctcagcttattatttgctgtgtgcatggggcaatgaacctatttcagttacacttgtgcactgttggcaagaaggtaaaatggtacagccactatggaaaatggtatgaaagtttctccaaaaattaaaaatagaattctcatgtaacccagcagtcccacttctgggcatatatatccaaaggaagtcaaattagtatctcaaagagacctttgtacacccgtgttcataatagcacttacactcacagaggaagaaatcatttgaagacacagagagaagagggccgaggagagaggtctcagagaaaccaacccaatgacatttcgtcttggatttccagcccccagaattactggaaaatacatttttcttgtttaggccacccaatctgtactactttgttatggcaaccctagcaaactaatgcagtcaccaacccagggtgaaaatgggacattcccaactctagctcttaggccaagcttatttgtaatagattcttgttttcaaaggatatagatattgagattctcaatgtatttgttaaaatacattgtttcttgttaaaagcataagactttgaaatgtctctgtgttgcagatatgtagatgttctgagccataatttttggaaaattctttcaaagaaaaggaaatctactggacaaatagcatgattaatggggatctagtgacaaaataatctgccctaattggatttgtgatgtttttgcaacttgaaattagcttcaaaacccaacaataatacgaaagaatgttcagtatcacgaatcaaattaaaaccataattaaatcacctcctttcattagggtagctactat

SEQ ID NO: 693 - DNA, 2241 bp, Homo sapiens
gtttctcagggaactccctggggttggccggtaccatggaggaagattgtcttcagcgtgcagggccagcgtcctacggcagtttcactctgagcctgtgtctggatcacggagacgcggggtagcggttcggagtgcggagcagggatgtccccgagctgtgcagctgcaagaacccgaaaaaacaggcgccatcttctcggcgcggtcctactccggactgtatttcccagaggcccccgcgagtccagggcagccccttcatttgcctgctggaccctccgcctcaagggtaggggaagtgcgcggtgagcggcctgggtcttgcaggctcggctggggcccgcagacggagtctcactctgttgcccaagctggagtgcagtggcatgatctcagctcactgcagcctctgctttccgggttcaagcgattctcttgcctcagcctcctgagtagctgggattacaggagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggtaagggcatctgtaccagtgattcccagttctcctctggaatgtctccttcttccacagtgaatttctcagctgcttttcaggttactagctgaatttctattctttattaccaaacaaatggtttgagctgaaatgaaaaggaagagtgggaaattggtaactccagtgggctgtggttgaagcttcatcttcatctttctttggctgttcctgtagtggcatctcttcctgtgatcatcaagggactggatctcctttacccccagcataaccatgttccatatcttttctcgtgagcaggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaagaatgtgggaaggcttttagtagtggctcggatctcattcgtcatcagggaattcatactaat

SEQ ID NO: 694 - DNA, 2232 bp, Homo sapiens
ggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaggcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaatttagtgttttctgacacaccttttgtggcgtccacttaatttgtgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtg

SEQ ID NO: 695 - DNA, 1935 bp, Homo sapiens
atgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgcccatgtggagtgcccgcctgctcatgtgcccatgtggagtgcccgcctgctcacacatgtcgatgcggagtgcccgcctgctcacacatgcccatgtggagtgcccgcctgctcacacgtgcccatgtggagtgcccgcctgctcacacacgtgtccatgtggagtgcccacctgctcatgtgcccatgtggagtgcccacctgctcacatgtgccgatgtggagtgccacctgctcacacacgtgcccatgtggagtgcccgcctgctcacgtgcccatgtggagtgcccgcctgctcacacgtgccgatgcggagtgcccgcctgctcacacgtgcccatgcggagtgcccgcctgctcacacgtgcccatgcggagtgcccgcctgctcacacgtgcccatgcggagtgcccgcctgctcacacgtgccgacgtggagtgcccgcctgctcacacgtgcccatgtggagtgcccgcctgctcacacgtgccaacgtggagtgcccgcctgatcacacgtgcccatgtggagtgctcgcctgctcacacgtgccgatgtggagtgcctgcctgctcacacgtgcccatgtggagtgttcgcctgctcacacgtgccgatgcggagtgcccgcctgctcacacgtgccgatgcggagtgcccgcctgctcacacgtgcccatgtggagtgcccgcctgctcacgtgccgatgtggagtgcccgcctgctcacacgtgcccatgtggagtgcccgcctgctcacgtgccgatgtggggtgcccgcctgctcacatgtgccgatgtggagtgcccgcctgctcacacgtgcccatgtggagtgcccgcctgctcacacgtgccgacgtggagtgcccgcctgctcacgtgcccatatggagtgcccgcctgctcacacgtgccattgtggagtgcccgcctgctcacacacatgccgatgtggagtgcccgcctgctcacacgtgcccatgtggagtgcccgcctgctcacacgtgcctatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagac

SEQ ID NO: 696 - DNA, 2340 bp, Homo sapiens
acacacctccctgcagcctggcactggaaactgctgagccatgcagggcagcctggtggcggctaggacacttctgcagaggacctggagttgggctgctcccggggctcccatctcttgctgggtctgttttcaggtgcaccctcctcctccaggaggcaggggcaagaccagcttcagcccttcttgctctccatggtctgtatatggacagggtgtgggcccggggagacagttgtgtggtgtgtgcattgtgtgtgtggggggggttgtctgtgtgtctgtgaatatttgtgtgatatgtgtgtagtatgctcatgtgtcatgactctgtgagggtgtgatggaagagtgtgtgtaagagagaagtttgagtgtgtgtggtgtgtgcatctggtgtctgtgggtgatgtttgtgtacatagtgtctgtgtgtgtgatgtcggtgtgttgtgtgggtttgtgtgtgtatatagtgtctgtgtgtgtgatgtcagcgtgttgtgtaaggatttatgtgtgtgtgtggtgtctgtgtttgtgatgttggtgtgttgtgtgtgggtctatgtttgtgtgtgatgttggtgtgtgtgatatcagtgtgttgtgtgtgggtttatgtgtgtgtgtgtgatgtctgtgtctgatggtgtgttttgtgtgggattgtgtgtgtgtgtggtgtctgtgtgtgtgatgtcagtgtgttgtgtgtgggtttatgtgtgtgatgtcggtgtgtgtgatgtcagtgtgttgtgtgtgggttgatatgtgtatgtgtgatgttggtgtgttgtgtgtgcatttatgtgtgtgtggtgtctgtgtgtgtgatgtcagtgtgttgtgtgtgggtgtatatttgtgcatcatgtcagtgtgtgtgatgtcagtgtgttgtgtgtgggtttatgtgtgtgtctgattttggtgtgttgtgtatgggtttatgtgtgtgtggtgactgtgtgtgatgttggtgtgttgtgtgggtttatgtgtgtggtgtctgtgtgtatgatgtcagtgtgttgtgtaggtttatgtgtatgtgatggtgtgtgtaatgtcagtgtgttgtgtgtgggtttatatgtgtttgtgtgatattggtgtgttgtgtgtgggtttatgagtgtgcatggtgtctgtgtgatgttggtgtgttgtgtgggtttgtgtgtgtggatgtggtttctgcctatgggaggaggtttgctcacagatggaggagaaggagctctataggcaaagatcccagggccgtggaggaggagacacagtcctgagaactccttcctctgaatcagaaggacaagaaaggtgggattttaaaggaacagagaaccctggtgggagaggtgaatctgagctcctcgggccatcgggtgtcctgtggagcagaggcaggcccgtgagggtgattttcagaatgctgcctgcttctgagagtgagatgaagaccctctggggtcccgttgatgtcaccaatgtcgcctgtcttgaggcatctctggtccagacctggctgggagagagagctatgggtggagatgcactgggtgggtgctggtgggaggggagggctggcttttcctcagcccccagacttagagaagatcacacgcaagagcttggaagtcctgggaggaagtatgatcccgaatcctggcacacttgatcatgcgtgacagggacttaagaaagcccctaattatagccgtgtggggtttgtctcccttctgaaacctggcgcccgtgtgctcaaggcaagggcgtgaccaaggtaagagaccccttctctcccttaggcagaagtcctagcagagtatgcccacgctggttagtgctgctgcaaagatgagccgaagaccatgagagacctccaggtggtccttctggggagaagaaatgggttttggccccaaatccttctgctgcatttttcccctatccctgggaagccatgagacctcaaacctgtgttcccaaggaggcgagctgctgttcccaggtgatgatatgatgtgcttggggaaagtaagtggctgccagacatggctgagagctgttgtcactgccgtcaagtgcatgtctccaagccatatcacacggcgtcccttgatgtgaggccacatggcaagtgggccgtggatctccctctgccctttgcaagcacgtaagacagcagattttgcagataccttgtggcgcaggggaatttcctttggccaggtctgaagaaataaagcagcaggcaccgagaacaaagccaaggctttcaaaagacaaggagccaaaaaacttactcaaaataaaagtagttttaaaatg

SEQ ID NO: 697 - DNA, 2144 bp, Homo sapiens
ttttttgagacagagtctcgctctgtcacccagtctggagtgcagtggcatgatttcgactcactgcaacctccacctccccagttcaagcggttatcctgcctcagcctcccgagtagctaggattacaggcacctgccaccacacctaattttttttgtgtttttagtagagacggggtttcaccttgttggccaggctggtctcgacctcctgacctcaggtgatctacccacctcggcctcccgaagtgctaggattacaggtgtgagcaactgcgcccagtcttatttccatttttgtaagtaatttttttccttttaaaaaataatttcaatttttcgtttagatttggggtacatttgcaggtttattacatgggtatattgtgtgatgctgaggtttggggtacaagtgatccaattacccaggtagtgagcatagtaccaatagttagtttttcagcctttaccgggtatcttccttcccactctagtagtcccagtgtctgttgttgccatctttatatccatgtgtacccaatgtttagatcccacttacttataagtgagaacatatggtatttggttttttgttcctgagttaatttgcttaggataacggcctccagcttcatccatgttggtacaaaagacttgattttgttcttttttatggctgtgtagtagtccatggtaggtatgtaccacacttgttttatccagtccacgttgatgggcagctaggttgattccatgtctttgctattgtgaatagagctatgatgaaacatatgagtacatgtgtctttttggtagaatgaggtattttcttttggatatattccaagttggaatagctgggtcgaatggtagttctggtttaagttctttgagaaatctccaaactgctttccacagtggctgcattaatttacattcccaccagcagggtacaagcatttccttttctctacagccccgccagtatctgttgtgttttgactttttaataatagccattctgactgttgtgagatggtatctcattgtggttttgatttgcatttctctaatgatgagttatgttgagtgttttgtcatgtttgttggctgcttgtatgtccatgtcttttggccactttttaatggggttgttttttccttgtttagttgttagtttcttacagattctggctgctagactattgttggatgcatagtttgtaaaaattttctcccattctgtaggttgtctgtttactctgatgatggtttgttttgctatgtagaagctctttagtttaattggcaatttttgtttttgttgcatttgcttttcaggacttaatcgtaaattcttttccaaggccaatgtgcagcatggtgctttctaggttttcttccaggattcttttatttgaggtcttacatttcagtctttaatccatcttgagttaatttttgtttatggtaaaacataggggtccagtttcattcttctgcatatggctagccagttatcctagcaccatttattgaatagagagtcctttccccattgcttatttttgtcagctttgttgaagatcagatgcctgtaggtgtgcggctttatttctaggttctctgttctattccattggtctatttgtctgtttttataccacaaccatgctgtcttggttactgtagccttatagtatagtttgaagtcaggtaatgtgattcctcaggctttgttcttttgcttagtattgctttggctattcagtctcttttttgtttctttatgaattttagaatagttttttctaattctgtgaaaaatgacattggtagtttgatagaaatagcattgaggccagttgtggtgccttacgcctgtaatcctagcactctgggaggtcaaggagagaggatcgcttgctcaggagtcttgagactagcctgggcaacatggtgggacctcgtctctacaaaaaattttaaaaaattaaccaggcatgttggtgggcacctatactgccagctactcgggaggctgaagtgggactatcacttgagcctgggaagtcgaagctgcagtgagccgtgatcatgccactgcccttccagcctgggtggacagagtgataccttctc

SEQ ID NO: 698 - DNA, 1975 bp, Homo sapiens
aaaatccgggcccttggtcccccgcgcgggcgcgggtggatctctcgggctctgacttgttttcgggtcaccttcaggcttcagccaggcacctgacgcctctttcccctcacggtgccagggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggtgcgtgggggcgccggagaggacccgagtccccgaaaaagtccatttttgtgggcatccctgtctccagtctggtcccgatctgctcttcgcttcccttagagtcacttccccttcgttccccgcctatgggccagatagggaaactgaggcttcagaggggcggggcttcccgaggtcgccaatcccctccctcctgcttcccagcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctggaaggtcaagatcttacgtcttcactgcccctgctcactgtgggactttgagtgacccactctccccctctgggtttcagttcatcagttcaagtggcgtccagccgccctgccttgcacgttgtaaaacgagtgctgtatataataggggtctgggtcgacggtgctgcactacagagtgtcaccctgtggacggtgagccctcaggagggtctcactctccccgtgggccttggcccctgagggtggctgtcagtgtccgctgagcttctgctcctcccgtccctgcccgcaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccaggtactacgggccgggaacgaggccagggtttggcgggtggtcagctctgggaggtccctccagccctgcacgatgttgtcctccatattgatgctgacctgattctccggcctgtcctcctccctccgcctctggggatgggctgctgagccttttcaccagttctttctgcccatctctttttcccagctcccagcccctccaaagatttactttcccatccgtgactcctggaatgcaggtaaggcacccagtttctttgcttggagggagacaccccagtctagcccctctccccacttcctggccattcctttctgtccatcctccttcctgcccgacacgtgtctcttagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctc

SEQ ID NO: 699 - DNA, 3053 bp, Homo sapiens
atgaatggggaataaggtagaaagtggaatggacaagtcctctctgtcaggcccagtacagagcagcagcccgggacagcagttaaaagttggagtggtcagagccccgagagtaactcacctgctgagaaggattagttatcagctcctaggcagcagccacagccaacagagaattaaacatgcacaacattagccaagacatttggggacccagaaatagcatgacagacacagggatccctcagcatctacactgtccacttcatcccagtgagacccatggttgtagacaggcacccataagtggcactagacaggagctgcttctagcagacatgcactcacggagaagccaaacgaagcggagatcaggcagctcctcccatctgcctagtgcgaccaccactccccagttagggcagaccaaacccctgagttctcccaccccaggctttgctgcctgttcttccttttcctctgctgaaaacctgcagagagggtggaggacattcctccatcctgggatgagttcacctttctaaatagaggaggagtcacaaatgaactcgatctggaagctccagaaagttgtgtttactgaggcagagaaaagcaagtgcccttgaatttgctcactgcccctcatctgtcctttgatgtgcaaggggaactgaagaggcacagcacgcacctctgttctccctgacgccgatggagtggaagctactgactcaaaactcgcatggggcacagagaagaccatgactcccaggacctcccctgccccacaaccaactgagagaagaggcaacaaggttaatacggcctccgggatctctccagtcctgctgctgggatttcagtcccagagactagacggcccactgagtgaggggaggcaggtgattggactgtgtgggctcagagaggtgagggggacaggacagggggtctttcagtcttaactcttctcaactcaccaagctgggaggccccagacccagtttgtacaaaatccataaccttctttcctgactggccccatcccagcctcacctcagggccctggagcctgagtaggctgggccagagtcctgtcctgcagaaagactctcaaatgaggaggtggcctgcgatcaccaagcctggtatgcttgccacacactcctctgtcctcaaccccactcgtggagaattggctcccaggagccagtgctcaaagagttcctttcagctccagcagccttagctgccagcctgacatgggcatggggttaaaaatgcctcctggaattaggagtagagaatccgatgctgtgggcacccacatttaaattaaataagcaatcatctggccagagccctaggagcggctgcatgtgtcctcagtcatccacagatcagggctgggcagaaagtgagctagggcaacctctccagctcagtggggagccaggccacaacagccagccattgccaggacccactcattggcacccagggaaaccctcaagactgagatcccaggctaagtaaagaaaacaaggaagatggtagcccagccccaagagggagaagtccctctggggcgggccagagataaagcaattccctgaggcttctaagctggtcattccccaaatggacttagagggaaggcccctagctgctagttaccaggcggattcctgggccccaactcatctcccgaatcacattccaggatgaggtctgagaagcaacccttttggcagtccccacagatactcggcacagtttcagattcccacctcaggaacaccctgcgctctgccaccaactcaccccctactttctctgtgactggaagaccagactgctggcagccacctgcacatagagccttgagagcaatatccaaggcttccccgggccttcccaggcccaggcccaggcccagccccagcctcagcctcagcctcagccccctgagtgacatggagcagcaccttctgccttccttgcaaggcaacatcccctgctcggtctcatagaggtgttgacagacaaaatgtggtggaaaagtggtttgagaagttattatgccttctaagcctagtccctaaatcctgggccaaagacagcaagggtccacagtggtcaggccttgcgactctacctccgatgctccaggatggaagagagaaatggacaaaacaccatttcaatacttggtgtataaatatgaaccataatacaagcatatttccccctatggtctgtgcacctctacttcatacctacatcctcagcaagaataaaatcatcacctcataaagaataaaatcattcagtatacatgtgaggaaggaaggaaagaaggaagggaaggggaagatggaggaagggaaggaaggaaaggaaaggaaaggaaggcaggcaggcagaaagaaaaggagaagctgaggtttggattcaagggtatggtccaagaggccagagggtatagggtcttacctggtgcctctggtaggctgaaaacatcttttcaaaatcctctaggtccaggatccgaaatacctgcatgtcaccaatctcattccatacggtgccagggacacgctcctaaaattcagggtagggagaagatcccatggttggcccaactccatcatgaagatgccccatgcctccctaaccccacttatctcccaactgcacatactaagatgaccaggatttcagaccttcagaaggtagtcggttgctcccctcaacctccaactctcttgaatactctgctccagggtagaggccagagacaacccccttttcctcccttgtgcatggagccacatgtaaacatgttctagaaatcatggggggtgctggggggatgggtaggcagtaggaaagggggtccacttcactttttccaaaagcaaagtcagaagctgcgctcagggtacttcacacaggcccactccccctaaagggcaggttgcctggagtcacccctgtccttggcagccatcattggaagattaaagccatacatattttggatcctc

SEQ ID NO: 700 - DNA, 2332 bp, Homo sapiens
atccatggccattgagacattagagcgtggggggggccgcctgctcgagcccacacctgctgctgctgctgctgctgcgggacccttaggtgcctctgtccacggtgcctactgccagggcctgggcaccctgctccctggcatcgtgcctcagtcatccgctgcctcagttccattcttaatctccccttcccctcgttggcaagctctgtagcaaccccagggcaccccctgcctttccctgccctgctaccctctcctccgcccatgcccagtccccggcctcctcccttgcgccccgtgcttcctgccatcctgtgctctctgctgcctgcctcgactctgctgccctccctcctggctgctcacggcacggccttccctctggcgcttccattctctccatcctcacagcggcgaccttatattttccttccattgtttctgtggtgacctcacttgcaccattgtccctgagacggcctcaagacgcgtccgtctctgtgggtgtatctcgggacctcccctctcatcattgctgttggggcctcccctcttctccctcatcgtcctccccagcagcgacatgcttgctcgagggcgagcccctgtgtcctgcctgctctgtggctagtgaccccctactggacatggttgtgctgtccccagtctctcctgtgacttcatgtgctcatttcgttgctgctcttgccccagttcctgtccgcatggggaggtgcccctctgggctcccaggggtcctctggtggtcggggcctcttggctcacaatctggctggggtgggctgcaccccactccccccaaaccggctcttctgtctggggacccggtggcagcagtcccatccaccttcctcctccctgggccaaaggggcagagggctgtggcggtctgggccgtggagcccaggaggggatggggcggtgccgcctgtggagctgctgggtggcactttgctctccggcggctcttttgcccggttctccttgttccctctggccttgctttctcccacgctgcagttgtggccctgtgtcccctcgctgtgcccttggctcctggcagcctgggagaacgggagggatggggcctgggctgccgagtggcgaacataccattccgtgctgaggtggacgcttggcctgtgtctgcccagcaggtgccgctgccgcccgccgccgccgccgccgcctcctcctcctcctggtcctcctccttctcctcctcctccttgtccttctcctcttcctcgtccttctcctcctcctcctcctcctcttcatcccgctgccgccgctccccaggcgcctgggtctctgccctcaccggtgctgaccgacttgtgcggggcttgagtataacttgccaaaatctttattctttcgatatttgcagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgccgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactc

SEQ ID NO: 701 - DNA, 2414 bp, Homo sapiens
agcagcgtgtgtttctcccttgcctctgcggcggcggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggtaagccctttggcgatgcttccagccagcaatttgcctcctctgaggagtccctcaatttctagttgaaatgatcagtgtatcatgcctggattcaaattgggtttctttctgagtttgaaacttgtactgaaagccctgtgctttcagtggcacacacaggagagtatccaaaaccacacagtaaagtgtgtgatgctacgagtttccccaaacattggaaacaggaaggaaaatgaagtgaagccctggacttcgagggatgtgatggaattaagggataacaggtttttgtacttaataatatgtattctgttattatttgctttcgaagctgctttttttccacttgtttattctatctagacttgctaagacactgagttgatatgccagcagtgcatgacactatcagcaacattcaaatgagagcttctggcctggcaggctggcactgtgcgtgcctctctgtgctcagaagttaaagctttgcaatccactaacactctattaaaaactagttaacattttaccagcccatggcctttgaaaatgcactctgggtggaagccataggtatgtctgatatgataacaaattgtatataaagctaaccaaaagacaattatatctgtttccctaggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataacaaggtgccattcctgactaataacacatagttgccagaagcatctgagattccattgtttagtactcaaagtgctcagaacaggtaaaattaaagagaggttgggggaagagtgggaataaaggcttttgaaagtctgaaccaaaagcaaatgttaatatttggaaaccttgctattcctacagatttatttctgactcctgagggaataaatattttaaattgctattataaaattagccaaaatcaaatcttcaatttctctcatctaaaacaagaaaatgacctgccttcttttgcattaatatcgtctgaggagggcgcaaaagagtcctcagcagaatgtgagatggttccctggtccctctggagtagaacacagccccatagagttaaagagggttttcactatgttcagtgtgaaaatcagtcatgtcgaaatgatatttttactttccactcttacgcaccaatgtgtagtatatattcttaactatagagtaacagagagggggaaatgcagatactgatctaatgacgtcaaatgggaggtcatggtaagaaggcctcacacctacggggagaaaaccagattccctaacagaaaactctggacccggggcacctgtgctgaaggagcagggctttcaggatcgctcagagacctgcggcttcacctgctctgagagcagtcctaaccatcgccccaggcagcctcaaaccctcctgcaccccagaacttcaaagaccactggggaccatgaaactgcttgcacaagttccttctcacacaggacaaagtaggggatataatttttaaaaccccagcccaagcttcacttgtcagagttgattcagggattgtgaatcacttagaactctatggaactatttaagcatctccttactgagaaactgaggctcaaaagagattcttcctcccagtgtctggtgctggttttcacatatcttttgtaaccctacatttagtccctttttttcaaaacccagtttaagttactatagatgtagcattcaatctttgtttcaatataacattttactacaagagaaatccattctcattaaagaaaaatggaaaaatacaggtaaaaataaagtacaactttagtaacattttt

SEQ ID NO: 702 - DNA, 2895 bp, Homo sapiens
attaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgccgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagagacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtt

SEQ ID NO: 703 - DNA, 2400 bp, Homo sapiens
agatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggtagggcgggcatggggccccagcatggcacagggccagacccaccccctctttgtcactgcccacatactgcggggggaggggctggaggaactggggcacctgcatttggcctgcagggaatctgggtcccgctggctgtgggtgaccgcagagggccatgtgggcagggtgcatccatgggcgccccaggccaacctcgtcagggtgggagggggaagggccaggaagcctcagcccagaccaggtatggtgggaacagtccacacgggaggggccagaaccgtctagaaggccctggcgtacaggtctgctgcaacagagccaggagggcacgggggtgcccacatccagggcagaggcaccacgtggtgctcagtcagtggtcagggtcaggcctggttggtggcattgaggacactgcaggcttggccccacctccaggagctgggctttctccacttgctcacagcaaaggcagggaccagaggggtggggggctgcacccaccctctcctcgctgctcccctcccccttaccaccccgtccagcgatgtccacgcagatgggagagttgtgagggtcgtccacacctggcctgcagtggctgcccagcttcctgctagggagatggggccggtgctgatggggaacagctgttgtgggggcagccagaggaaaccacgttcccgtggggtgagctcatggtttacacgttccctgccagatccataacatcctggaggcagaagcgcagaggctgagcccgcccccgcccccgctgagcctcccctgctctgacaccagggcggctcagccatcctcgcttagcctgcacctcctgtcctgaagccccttcctccctccacttgctccctctgtcatttactccccagccccgacccaccctgctcacccctgaagcttctctgggtcctggactccgttctgcaggctggacgccttctcaactgtccgtggagcctgcctggtctctgggggtgttgagtgaggggtgacccaggaagaacgtgtcagagacagtggacagggaagcgtttctcaccccttaactcacagcagccccaccgggcggacacaaccatcaacccagccgcaggtgtagaaactgaggcacacagacgcgatgtggctgcccgtctggtaactagcagccgggattggagcctgggtccaagctgcctgttctttctttcctaggccatgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaaatgacgcttctcagctatgcctggtgtgacccccagggtcttggtcggcatgaggccacagagctcacgtgtacttcccgcagctgcttccacggtatagatgagaggttcccatggagctcacatgacctctagagacttgcagacccctatgctgtcagacagaggaggctgaggctcagagaggcacagtcaccttcttgaagatgcacagccgtgagtgaagaagctgggatttctcctggtctctctgaccctggaacacgtggcctctgggtgtgcccagtaagagacgttaaagaagggcctcccccatgagccctgactgaggcggggcgctaggcaccccatcgatgtgcttcgtggttcacaggggagaggcagagggcctgtcggggggcagcgatggggcagccagagggggcggtcctggcctgtgtgagcctccttgaggggagggtgccaggaactaccccatgatcttctattctcatgtaagccacaagatcccaacccagatccccacagcaaaggcgaagtcaccaactcaacaaggcgcgtggccaggcgtggggctcacgcctgcaatcccagcaccatgggaggctgagcaggaggatggctcgaagccaggagttcgaaaccagcctgcgcaacacagcgagaccgctctacaaaaat

SEQ ID NO: 704 - DNA, 2335 bp, Homo sapiens
ctttaataaaatacttcaacaaacacaacagccaattgcagtgtggtattcttgtttggatcctggaacaggaaaaggacattagtggaaaaactagtgaaatccaaataaagtctggagtttagttcatagtaatgcaccaacgttggtgttttagttttgacagatgtatcacggtaatgtacaatgttaaccttacaggaaatgggtcaggagtatgtcggggcactgtattatctttttgttttgttttcttttcttttcttttttttcttgagacagagtctcactctgttgcccaggctggagtgcagtggcacgatctcagctcactgcaacctcccactcctagttcaagcaattctcctgcctcggtcttccgagtagctgagattacaggcatgcaccaccatgcctggctgatttttgtatacactgtattatctttacacctttcctgcaaattcaaaattattctaaaatgcaaagttgatttaaggaaaaaaactaaattaccagaaaaaaataaagcaagaaaaagccaaactgttatgatatgttaatgtaggttcatcaaaggtactgctgtggtaggggatattgataattggggagactgtgcatgtgtggggacaaggaggtatctgggaaatctctgtaccttcctctcagttatgctgtgaacctaaaactgctttaaaagataaagtccttaatttaaaaacaaaacaaaacaaacaaaaaaaacccacggtgttatttccctgcctgtggagattattaacttattattaaatgtgatgtgtattatctgtgagcataactaatggagtcctctttctgcctcccccctttctgttttgcagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcag

SEQ ID NO: 705 - DNA, 2058 bp, Homo sapiens
gtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaaacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtgttccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcccggctagcaacactcactgtcagttaggcagtcctgatgtatctgtacatagaccatttgccttatattggcaaatgtaagttgtttctatgaaacaaacatatttagttcactattatatagtgggttatatt

SEQ ID NO: 706 - DNA, 2341 bp, Homo sapiens
actcaaaactgccagtgtgagaggatttggaaatcactggatctgctcaatacaaaaatgttttttcgagtctttctccattttatcaggagtcattctgccactgcagtggatttccttcctgtgatggtgcaccggctcccaggtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtgatagtgacgattatttaaactattacgatatataaccatctatacaaacataaatcttgaaaatagatttttttgtgtatgtgagaggatgttgaaactgctttctccctttgagtgtgtgcttagcgtcgtctacagtaagctgtggtacttaaataactctagggtttggtttcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtgatgaaaaactctttcctttttgaacttttcagagacctgttcttccctttgaattagtttgttttatttaaagtagctcttaagattcttcagtatttaagcagctgagccattttcttttatttgagaactatgaaatcatctaagttaggggtatgttccttctagggaatccaaattgaccccaggcccagcaaaataattctatgtttgattttgatgttattttgggagcaattgtggggttagggttgttaggacacctatatttaaagttgatggcaaattatagttacacaaattgtgtttgatggtgatggaatctgggactgcaaagactccctctctttctcccatattcaactcagtaggcctgattcttttacttttggaatattctattgacagcctgtgttagtctgttctgtgttgttataaagaaatccccgaggctggataatttataaagaaaagaggtttaggctgggtgtggtggctcacgcctgtcatctcagcactttgggaggccgagggggatggatcacaaggtcaggaaatcaagaccatcctggccaacacggtgaaaccctgtctctactaaaaatacaaaaattagctgggcgtggtggcacatgcctgtaatcccagctaattgggaggctgagccaggagaatcacttgaacccaggaggtagaggttgcagtgagctgaaattgcgccactgcactccagcctggcgacagtgcgagattccgtctcaaaaatcaaaacaaaacaaaacaaaaaaac

SEQ ID NO: 707 - DNA, 1866 bp, Homo sapiens
tttccgaaatagaccccaatattctgcctttaccccggaggatgcagatgtaccttctctcaggccgatgacctcaggcctccatggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccaattcctccccacctcctccacctccccaggccccactcacctcctccaactcctctggggaaacccaagccctgcagctcatggaacaggagaagtggaaccgacgtttctggaacaggactatctgagagcggttcttcctggccctcgggttcatgcgacggcgtaactggaaccgacgcttacggaccaagggaagtggaagatgttttgtttggagtcctcgtcgtcctcctccatgtcattggccaggtagctgaggacaggaatcaggttgccgctcaggggcaccaccaggagagacctccggctgaggtcagcttcccagagaggaagagtaaagaggacaaataggtgaaagaacaaatgaaaggctggaatcccacttcccccgctgtcccagggcattggatattgacggataggaggcagcaaaccactcacagagccaggaagaaatgaaggcgttggtattgccaggaggggaagccggctcggctgaaatacgctatgaccatagcaaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatccgagaagccagaggaagggttttgggtgatgctcccaggatggtgggctccgatgggatctttggagggggtgtgtctaggttggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtactttttgagaggtggagacaggaggatcatgtgagcccaacagttcgagaacaacctgggcaacatagtgagaccctgtttccacaaacatttcaaaaattagttgagcatggtggcatgtgcctagtcccagctcctcaggaggctgaggaaagaagattgcttgagcccaggaattagaggctgcagtgagctatgatcatgccactgcactccatcctggggagcagagctagattctgtctcacaaaaaaaaaatttgtgggtgccaagactcaagaccatgggagctggtcgggcacagtggctgacgtctgtgatctcagcactttgggaggccaaggtgggtggattgcctgaggtcaggtgttcaggaccaacctggccaacatggcaaaaccccgtttctactaaaaacacaaaaattggccgggcgtggtggttcatgtctgtaatcccagctgcttggaggctgaggcaggagaatcgcttgaacccaggaggcatcggctgcagtgagtgaagatcgagacactgccctccagcctgggcaacagagcaagactctgtctcacacacac

SEQ ID NO: 708 - DNA, 1867 bp, Homo sapiens
ctcgaactcctgacctcgggtgatccgcccgccttggcctcccaaggtgctagaattacgggcgtgagccaccgtgcccagcggtcctgctatatttttatgttttatattatttgtctcaaggttcaaagaaaatgacgattgcattgattcatggagaagggtgcgttaatatttctgaactttagggttggaaggtaaaatagaggatgttgtaggagagtatgtggggacccttggtttatgggggccattccttaggcaagggtcacatctccatctgggttgatgattttgtcatcaacaaggcaaataccctggttttcagaatgggaggcctagaagatgctggaaggtaccaccatctttgttgggaagggaatgcgatgacgagctggaaggttcctgttctcgtctgtaaaatgactgtttgaaggtgaaaaacatccatgttttcttcagcaccgagtcagtctatgacagtggctctcagccctggtgattggcccccaagggacatttggagacgttgattgtcaagacttggtgtgggcactggattttaatgggtgaagcctagacattttaacgggtgaagacaacatgatgtttgtgctgctaaacaccctacggtgtgtgggacagccccatcacggagagtggacagagccagcgtatcatatgctaaggttgaggagccctggtctaatgataggagcaattcaagatctgtcttcactgccttcacagagagccatgtctttcagaaaatgtgctggattagtctcaaggaccatttttttcagaggcttatttttaaatctgttcagaggagtggggaagacccattcagaagagttatttcacaaacacgtggcaattatcagtgcagatttcttgttaaggttccctagcaatgactgtacttccccagtagaaatggggtgtgtgtgctgctgcacaccacaggcagatgtgggagaccctgtttgttttgtggcagtgggaacagtcgcaattttagagaggacttattgaggggcatttgttactttaaacaatttagtgccatacaaaggattagacagagctcctgaagggggaatctccctcattttcagggtgttaactacagaggagttgagggaaggggccatggagggaactgactgagacaggtagagcatctaccgcccaaaagtcaaagcaaagacagggttagaaggacccagctgggcattttctgctcttgaatctgcggagagtgtcattaggccaaaattggcatcctctctcttctgtttatcagaaaccaccttctcatttgttgtccttcattttaaacagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacagatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaac

SEQ ID NO: 709 - DNA, 2120 bp, Homo sapiens
acccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggcccttgctgctgggcagttgcacatatgtattatccaactaaatcattacaagactcctctggttgatcattttggatttaatactgtgaaaacttttaatcagcggtacctagtagctgataaatactggaagaaaaatggtggatcaatacttttctacactggtaatgaaggggacattatctggttttgtaataacacggagttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactcttaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgctcggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcaggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtactggatttaatgactttgaactgtgctgtaaataaataatacagctggacctt

SEQ ID NO: 710 - DNA, 2287 bp, Homo sapiens
aacaaaaggtcaaagtggactgcagtgtaaatgtagagaagcagccgataaaatagcattgcctgaagaagtttggaggctgagagcagcaatagactggccaactgcagagcaagttgtttctccagccgtgcggtgcagcctcatgcccccaacccagcttagccactgtaagaagacgttcactgtacagacgaccaaacttgccgtggaagagacagttgtgagattcccttgcaaatttacatacgagaatggcttgtgaaatcatgcctctgcaaagtgctcatgtaccccaagtcagcaatgtgtctgcaaccggagaactcttagaaagaaccatccgatcagctgtagaacaacatctttttgatgttaataactctggaggtcaaagttcagaggactcggaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagtaatcaccaagactgtcagctgcctgcagttatcgggaagagcagcctggggaaagttaaaggagcacagatggacagttgctttctgcatgcaagtggccagctaggatccggggggcatcaagccatgatttttatttctgtgctggatgcattagcagctgtgacttggaaggttttatcctgaaggagtggaattgctgcagacgtcttggggttttggtgagcagtagatatttggggacattgtgctgttattgcagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccacaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccagaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattgaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatg

SEQ ID NO: 711 - DNA, 2496 bp, Homo sapiens
acattctggccactgccactgatgcccagggattcttgccggccagggacaagaggaagctgggggcgtccgtggtaaaggtgaacaaagtgggccagctccgcgtgctcctcgccttcagacgtgaaaggggtgaaggccttccacgtgctgtccactgactacagctacggcttggtctacctccgcctggggcgtgcaacccaaaactacaagaacctgctgctcttccgtgagcaggcacagcggatggcagaggatggtggagggggtgcagagggaggcatagaggggcgctgggcacagggggccgggcaggaggtgaggcgggcagggagagtgggggttggggcggtggtcagggcaggggcaatggaagccgagaccacagcagtcaggtcctggaggtcgctgaagcaaggataggggacgtcaggaagaggctgcagagaaaggtgggccatccagggggagcggaggccaccaggatggtggcgggtgcaggtgcaacgttctgggtgagggacacagtggggatgaggaggcgtgggaggggtcccaggtaagggtctgcccgggatggaggggtgtggaagtgacccagtgtgggttaagggccacaaacccaattctagacaccaaccacttggggtacacggaaaggagtggccctcccggttggaacgggtagaggggaggtggggtcctggggtctcagtcgaggcagggcacgctcagggtgcagcaagctggggcacagctgaggggctggctggaggggactctgcaggcagagagggttccccaggtgatagcgtggtgaccctggcttcccaagcctggctgcctcgtaagtggggaggggcccagcggccgctgtcctcccctggccaacccctgcttcacgcctaagctctgaggacatttcagcagctcctggggtagggatgggggtcagggtgcagaccctaaaatggccagagctggagtctctgatgtgatcctgatctcaacctcagataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttccagatgtcaagtggagaccacggcttgttgagaggtgtttggtgactctaggtcattgacagtgtgaaaatcaagtggctcaagggatcctttatgatcacagaaagatgggggaaggaggatacaggctgaccgggtggcgagatgtcagccaggccccttccccactgtcttctggagcacactgcaggctgctgctattccctgtctgctgtgaaacagaccacaggccggcccaacgcagtcctcgccgtgtgccttgcctctgccctccacgccgccgccaccctccgcgttcctttacatcctgcactttctcaggaagccgttcgcatatccacccaacatggaggagcccccatgacgtgccaggcagcgtgctggcccctgcggctgcgttagggaacagaatcggcaaacgcagtcccagagttgatgcctgatcaggagaagccaacttcagcagtgtggtcacctggatactcgagtatagaccctagatcacctggatactcgagtatagaccctagaagtgtatctaggcgcggccagggccccacaacagcaggtctgactcattccatccagggcagcatcagggagagcttcctgggggaagtggcatttgggctgacctgggaagggtggtgggtgttaagtcagtttgggtggggctggaggagcaggggtgcatccccagaacaggatgtgacttctgaaaagacatcagagtagagaaaatggtttctcaaggagattggggacgccagtatcagaatggcggcggggagagccacagaggagcaggagggggcccaccagaccacggcacctcgaaggctgcggtgaaggcttaggtctcactcaaggggtgatgacgggaggttgtctgagatgaaccccccaactgaatgaatggaccttcttctggccaaggggatcccaaagaaaccctgaacccgagtcctcagccatgacggggtaaggggtcagcccctccttctggcccgagaagagatcagagattggttctgggcagtccatggagaatttgctcagctggaccagtacacgcttctcctttcatgaatattcatgactcctcctgaagcttattgaacatctctatttggccatctccttcagcgtaaattcctgtcccctctgtccctcccctccaagtgtctgttccaggcttctggcctgaggctacgcttcctagcctgtcagaagggctgccctgctggctgcaatctcttatgagaaataaagctctcctgtgtgc

SEQ ID NO: 712 - DNA, 2205 bp, Homo sapiens
cttttgcccaggctggagtgcagaggcacgatcctggcccactgcaatccccacctcccgggttcaagcgattctcctgcctcaggcttcagagtggctgggattacagtggatttatcttctgtggcagataaatgaagtaattcactgctataaaatggaagacattgacattgtggtagtggcagaagtcacattacggttaagtgaaatattggaatctttaggaagcccaggaagaaaatttaaacaatctctagatgtacctttaagagaagggactaacaaattccctggagctccaaaagggatcacagaaattcttccaatattacagaaaaatcctgtggaacagttactttttgcttataaacttcttgacagagcaatcggtggaataaatttgaattgcatgttaacctctttgccaaatggatcatcagtaattgaccactgctatgccaagcgtacccaccatatagatggagatacttacaaaccacttgcctcaaatagtttcatgatggatttgcatcttgaactaattcaagctcagcatcgaatagctgttgtgcttctggacaaattgcaaggaagcatattccttaattcagaggattgaagctgaacaaaatgccctatattcctatcagaaatatttggaaagttcaaaaagaaagaaaagcagagtcccccctccacctatcctgctgtctcgaactcattgttctgtgacactcaaacctgctccatttacttcagaggttaaggtctcctggtactgcattttgggttgcaaagcagaaggaagttatggaaaagtacggctaaacaataatcatctcccaaattcaggagaagcgataccagctgacggtaaaagtgtttttgaagtgaaaggtttagaaaccaatgaaaagtatgtatttgcagttgctgcctattctaacaacggaaagcttgtcggtggtgctattggggagacaactaaaccaattctggtttatccccctctttctactattactgctcggatgttcctgacacaggttgcctatcaagttggtaactatgaattggctaagaaagttttctcaccagtttgggattattttgttgcttcgccacttcaggatgaacaatctgttatttgtttaagcaatataattactattacacaaagaagattacattcagatattttggcagagacttcttcaatcctcttgtacctttttcttagaaatatttttgtaacaagtgacatcaaaattaaagaagaaaatcttttctgtgataatattaaaggcaatgagattttcccatctcaacaaattgccagactgattgaatgtgagagagtattagtggcattggaacttagcaacttcctaaatgattccagctatgcccttcaagctgtgactcaatgttatggacttcttgctcccataatttatcacaatattgttttggtacctgttgtacagatcctgataaagtgtatagtggttttgcaaggactaccaagtattgtctgctcgaagaaacatactgcgagttttgaaagtatacaacacatgatagcttgttgtattttctacataacaaagattcttcgttcatggagggaatatgacctggcagtaatgattataaattatgggaaaaaaatgttggacatcacaccaggatgcaagtctctgtttgatggtagtaatgaacaagaagaaatgccagaggaggattcttctaagaagtctttaaagactaagaagccacagcagatactactgcctgaaaagataaatgaacagctggccttgttggagacacacctactcaaactgacaaagcaatatgttacatctgaactctcaggaggagaggaccctatatttctttatcctgtagttttgaattggtcggtcaaaggtgccgtgaaagaagttatgaaatttaagcaaaaaccaagatttctggaattctttacacaagttatgctaaaatgcatgaatgaggaaaaatttcaccttatggtagaggtaacaactcctgtccatgacttcttgaaaaggagaaatgagtctctacttggactaataaaagtgaaatataaggatagtgctttgaataaaaaagccaacaaatctttaaagttcaaagctgcagtaatggaaattggaagaagtgcagaaatgcaac

SEQ ID NO: 713 - DNA, 1903 bp, Homo sapiens
tctatgacatggaacatcttggtgattcactggtttatcccatgcatgtttattaggccactaaatttaaaagcaattttaatatgcttgatgaaaggtacatgccttaatgagagtcatctttcttaagaaattaccagattgtgctgtggcctggggttcctgtttctctttaggcctcatccccaccctcctgccctttgtcctggtgcccccacgtctctggcttctggcttcacttctcccaccaggacccaaccattctccctcctggtttgcctgggtgtcccccacatcctcccaggaggagctccctatggctgctgcctgaccacgtagggcctcctgcgtacggtggtctgaatgggaactgctttgtcaaggctgcacacgtgagctctggggcccaggactgtccagggtctgactcagtacctcctctggggaagcctcaggtgatgctggtcacacaggggctcctgttgcagcacacacctgttgaccaggtattaggggttttcttgtttgttaacctgcatcattgtctatgcactggagactaccctgcatcagaagctgatgtttcatcttatcccctctccagtgtggccgacaccccatctcttgggaggtcaccccacctttgagcacccccagagcctctcattctcttggtccacacctgagccaggcagggcctgcttctgggttctgcagcactgctcaggtctctgcgtctccaccccaggcgcaccgccactccgtggtccccatggtggagtcagagtgtgcacctcctctccagtgcctcttcccatggcactcccctgttgctgcacctgatccttgcagtgccgtgcagcttgtctcccaccacatgcagcaccttcctgtccctagtgatgccccttctgccctttggagcaccagaccatccatggctgtctgatttcctttaaagataccatcttccttgaagaacatgaagtctgagggtacctgtgaaggggccccttccttctgctgatgcagccctgtggttccgatggccgcaggctgcgctaacttgagcatgtccagccaccccttccctgctggccccccagttagtgctggcgttccactcttgttgctctgtgcagggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcggttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagc

SEQ ID NO: 714 - DNA, 2069 bp, Homo sapiens
atcaacagcagtccctacgctgggaagacagcagaggtgtgtagacaggtagtgccaagcgtctttctcatcctgaatctcctttgtccaagctcaaggcctgtgatgaagactcactctcaggcctttggggtacaagaggctgccatggttattctgtttggaaaacacttccagagccctgaccccacggtgcatgggtggctctgcctcatcacccagcaagcctgaggggacctgggtgagcttcttctttgccctccaaccctgcaggggcgtcagggcaccatgcaactcatgcccacatgcactttgatggagagcgtcccaggctggggacacacaccaaggcttgccatcacgttcttttcatcagtgtaacagcggtaactgtccagggacacgcaacctccttgtctcccatcacactccgtggcccaaacacagcacagctggagccgggaaatatccactaggtgaatgcccatcactgctacacactcacagctgtctccctcggcacctgcacacgcaggacagctctggacaggtggggcactgaggcagcccagccaggctgccaagacagggctaagaagcccagtggaaattgtggatttcaccaaagactcccagagagaagcattgccatcccctcccttctttaaatgcaaagaaaaaaaaatagtttgttgttctcaggacttctgggcatggcagtctcaaaaatgagccaaagcagacaagaaagggcatgcaaggccttctctgggtgacagtgacgaagggtgagtccttcagaacgctctactctggaagcccggcccactgcagagtgacatctccgtcacttggaagggcaacgtcgtcccccagctgtcgggtccagttcatgcttgtgaaagtcctatgtgtgtggccacacatgtgaggacacattagagtagtttgaaactgaagagagcaaattgcagaatgaggacagttctgacagaaatgtacctcttttgcagctgatgtagctgaaagccattggctgctgcacgggagcagcagttgtataagaccgacacccaggaagccccacctctcctcgacgcttgtttgaaatttctgccaaggagtgtccatgacagtgggtagcaggggcctcctccgcccctgcccagcgcatagggggagtccagcaggttttgcctgagctacctcgctcaaccggagtgggctgctcctgtaaaacccaccctccacgttggaatgagattccagttcatcctgacggctgaccactggagtggcagcccaccctgcagccctcagagcccctgaggggccctgggtatggttttgcatgctgctcactggccctgctcattggcccttgcccctgtgaccctccttctcctcgtcccaccccaggatgttacgcttgggatgtggccgtgcacacatccgtacaagtgtctcaggagcagtgactacaggttagtccttaaactagtaaccctccgcacacctcgtcttgccctaggaccccttctccctcccaggcaccatgatttcccttaccctcggtctaccctcgaaaacaaccaccaaacatatcttacaagagttttttccattgttttggtaatcattcatataaaatctcataacaaggatagtcaaggcatactcaacatcactaatcaatagagaaagacaaaaccacagtgagatagcacctcacccccattaagaaggctttctggatcatttaaacaatgaagaaatgacaagagctggtgaagatgtggaagctccagagccctgtgcactgctggaaggaatgcaaaatggcacagctgctgtgggaaacaatgtggcaattcctcccaaaattaaaggcagaatgaccatctgatccagcagttacagttccaggtacctacccaagcaattcaaagcagggactcacacagatatttacactgccatattcatagcagcattctgcacaatagccaacagataaacatagcccatgtcggccgacagatgaatgaataaacaaaaatatggactct

SEQ ID NO: 715 - DNA, 3321 bp, Homo sapiens
acagcgtgagggccgccgttgctggagttcagcttagggaaggaggactctgaggaggccccgagccgcggagcgcttcgggggaggcgcccgcgcagacgcgaggcccatagccaggaccaccacctagctgttctacagtctggggacgacggtttaaaaatttatgccttgcatgcgatgtgcagtgggtgatggaagaacgtctacatggctttaaaattggatttaaaaggcaaatattttaaatgaaggaaaacccaagaagtttacttgattccttatcttccaggatgcgacttttgtttatttatttattttattttgatggagtctcgctgccgtcgcgcaggctggagtgcagtgacgcgatcttgacccgggaacctccacctcccgggttcaagcgattctccttcctcaaccacccgagtagctgggattacaggcgtgtgccaccatgcccggctaatttttgtgtttttagtagagaccggggaaggtatgggccctcttttgagaaaaatgcagagtgacactgaattttgtaactacatcaggaggctcttgaaccttctgcagctcactcgtggagtttgtagagatgcgtaataatccgaagtgttaaggaagaaggttctgttgagaaaaagttggagggctgaaagggatgcctttcgctatttcgacatgtgtggctgtaccccagagtgccctggctaacacgcaaaaccatgaattaggcggcttggcgaggctcagtggaggctggggccgagagtcatgtcaaagtttgtggggttaacctgcacccagtgacagtcatggcgaagtttgtgaggttaactcgcacccagtaacgctgttccaatgcaaggtgtgtatttggtgtcatccacgggaagaggaaacagcaaattttctcatggccttggcagttccacatgatggacatttcatatctgcagttttcttcgcatgagatggcttttttgcacaaaaacactggaatccagtgagcaagaatgatagaatgcaagatggatttccacatgaggaagtgtcacgaacaagcgttttgcatctctgtcagctggattcccccatgtgaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcggtaagtataccaccggtcggggcaactcaaaattatacttattgggcatatgttccttttccccttctaattcggtctgtctcctggagggactctccagtagaagtttacactaataatagtgcattcatgccgatccctaatgatgatcggtttccagctcaaccggaagaagaaggtatgcactttaatctgtcaattggctataaatatccaccattatgtattgggaagtcgcctggttgtttaacttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccagaaggacattattggcaagattgctccagcaaaaataccttatgctcggagtttatttattccttagattatatagagcatgggtggcagtcttacacgatgagacaacgggtgtctccttacccatttaaatggatggacacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttatacc

SEQ ID NO: 716 - DNA, 2026 bp, Homo sapiens
agatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggccggctcggggcgcacggtcagcgtggcgaagtaggtgtcgttgccgcccgcgttgctggccacgcacgtgtaggtgccgctgtcctgcggccgcgcgtcctggatctccagcgtccccccggggagcacgcgcgcccggcccgcgctggtggccgtcaccggccggtgctggggggtcacccaggccacggtgggcgccggctcgccctcggcgcggcagaggaagcggacgtcttcgcccgcggtggccgtgacgcgctgcagccgccgctcccggatcttgggtttgcggcacacgaagtactcgaacagcacggagtccggcaggtttcgcagcgcgtcgccgcgcacctcggccggggtggcgcaggccggcagccgcccgtcgaagttgagggtcttgcgacgctgcacgatccacagcaggcgacagtcgcaggccagcgggttcccgtccacgcgcagcgtctctagcgtgttcaccgagtggaaggtgctctcctccaacgtggagagcaggttgttggagaggttgagcaggcggatctggcgcaggcccaggaaggcctgcggctccaccacagccagcagggccccggccaggtgcagctcgcgcaggcggaccaggtcccggaacgacccccgcggcaccgtgctgatggggttgtgcgacagattgaggcaggtgaggtgcgcctggtgccgcagcgcggcggccggcacggcggtgatgttggtgtgggtgaccgacagcgaggtcaggttcaggccccgcaggctgcccgccgccacctcctccagcagcggccagttgtcaatctccaggtgcagcagcccgggcagcctgcggaagttctggtcctccagggaggcgatggccaggtggcgcagccgcagggcgcccaggctgcgcagatggcccagcgactccccggacagagccgtgaggttgcagcgctccagggtcagctcctccagggccagcagccccgcgaaggcgcggcgcgagacgaataccaggtcgttgtcgcccacttccagccggcgcaggctgtgcaggtcctggaaagtgtagtccagcaggattaccagcttgttctcgctcaggtccagcagcgtgaggttgtccaggcgcgtgaagaccccgggcgggatgagcttcagctggttgccacggagacgcaggacgcgcaggcgcggcaggttggcgaaggcgccgggctccacgtgcgcgatggcgttctcgctcaggtccagctcctccagcgcgggcagcgcggccaggtcgcccgggttcaggcagcggatgcggttgcggctgagctccagcaggcgggtctcggccgggatgccgtcgggcacggcggtcaggcggcggcgcgtgcaggccaccgcgcgggtctgcacggtgcactcgcagcgggccgggcagcctccagccgggggcggcgccgcgggcagcaggagcaggggcaggctcaggacgcacagccagcaggtcatggtgcggagcgtgggcctagggccgcgccaccatcctcctgcgcacctgcgggcgggcgggggagcgggcagcgttagcaccgttagcacccctccgcggcgcctctgccgccagcccgcccctaacccgtcccagcacggcggctcgctcctgtaaacccagcattttgggaggctgagatggaagaattgcttgagttcaagagttcgagaccagcctgcacaacatagcaagactcccatctctac

SEQ ID NO: 717 - DNA, 2137 bp, Homo sapiens
cagaatctccagagcagagcccaggaatctggattttgtacccgacacctccccatctcccaccccccacagagggttatgcacagtgatacagcgatgcttggaaaccactagagctgtggtaagagcgttgggtttgacctggactcaaacttcctcctctgccgcttaaatcggtgtatgaccttgggggtcttctctatctctgatcctcagcagggaaggcgagggttacctgagacaaacctgggagcctcctgacacggagtagagaccacaactaactcagcacgtagggcaaacagaaacccattgaacaaccgggccggccccccgcgcccaactcaccgctgcccggcggccgctccgaggagccgggagggagggttgcggggccacagccggcacaggcgcaggggcagtaagggcggcatggcggcgggcgggcagctgggaaaggaggctaccaagagcgcattggaccaggatggggctagacttcaagcacccgggggcagagggaaggggcctggcccgttgttctgcaaaggaagactgaagcaggcccggagagggggcggttcttgcccaggaccagacccgcgtgtccttggacctgccccttcctctgacccgggcatccgcagcccttcccagcgctggcttcggggtctggccacccagccagggaccccaagaccccgttcccacccagggaacttggggacgggagaaggatgggccacaaccaggccccgcccccgctgctcacagacccgcggccgtcgccatttcctgcgtctattcaggccccgccctcacattctcattggcgtggatgccaagaccacgtccacctgtcagaaaaaaaaaaaaaatcggtggagaccccgcccctacatgtctattggcctttggtgcctccggtcccccagcctgcggactcgctggacaggcgcgggcgcccacctggggagcgggcgggacagagcccgctctctgcggctttgtgacgttttcggcccggccaccgtgtctccgttccgctgttgctcccctctgcagcgaggtatatcttacggagctgcttccgccccggagcctctctggagccagcaaagaaagggaggcacagttcttatcccctgcttgcagagggggacacaggctgggcgggttttttttttttttttttcccaagtcacttgtcctgccttacacactcagggcccattgctcctctctgttacagaaatagcagatgccaacggaatccaagaataaagtcgtttattattttcagagcggcgggagtagggctggggaccctagggccgctccagtgggacttccctgaacccggttgtagaggatgatggcgcctttggccgaggggcagagttcagcccacatctccgtctcgggcaatctccgcacgttctgtggggagacaacgagacccaggcattcaagcttgccacttctcctgccagggctgtgcccagaattcctgagcctcagagacctctgcactgtccttagggaggcatgttaaggggctgaacatgtccctggacctttcccttgcactgagggcaaatcttgtgactctggagggaattgtgacccagccaacacctcccctacaagatatgcattgccaggcctctgcaggccccagccctggcctccaagcaagatggtttgtcactctgcacctgtgtctccacaaagaagattcctgtagactcgtgggcctcgggtcccccactcaggtagtgcttcctcacctgctcagaagtcaggctgcacctggacaagaacacaagggtggcttagtgggtgaccagcccctgcggggtacctgtggagccacagctgcctcagcccactcctcaccacccaccttcccaagacccaggatcatgtacccgagcctactcactggacatagaactcggcactggctcggccagcactggtctcatttcgggcgatgcccaacagcaggggctggctcagggtgagcagcggcaggttcacctgcggtggagggtggggtggggggaggtcccacctatcaatgccactgcccacatccctgcccgtctcaatgaaaaaccgcctgttacctgtg

SEQ ID NO: 718 - DNA, 1933 bp, Homo sapiens
tctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcaaagcaaggctaggacagaccaggcagcagtcatggagaagggtagagcagagaatgcattactacaggactcagagaagaagaggagtcattcttctccatcacagattcctaaaaagattctcaggtatgtaaaatagactggaagaatatgggaattttttaacacattttcaggtgctaagttttttatatcttttaagattgcataagaaccatttctgtttgtaagtagcactctgtggccatcatctatctttataactgcattccaagattagaatagtattaaagtgatcttactgcactgaacaaggtttatagccctggatctttggcttaagtagcctactgcattctggtgaatgcagaggaactttagcatagaaaagcaaatccataacaccttaatagcaataaataatgtgttgttttggaatgtgatggtagtgtgaggaagaaacagtatcaaatgaataaatggtggtactgttctttccctcactgtaaatgaaataaagctcttccagc

SEQ ID NO: 719 - DNA, 2341 bp, Homo sapiens
agctgcgagcgagcacccaggccccgccgccgccgccgccaccgctgcccgcctgccgccgcccgcctccgcctgccttctgccgccggccggcgcgtcgtccccacagattgctcatttagaaagtggatgtgtgggataacatgtccaatgtgtccgaggagagaaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaaattaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtc

SEQ ID NO: 720 - DNA, 2071 bp, Homo sapiens
atttcaatagagctttgcttttgttgcttcattctttccttgctttgtgtgttttgtccaattctttgttcaagacaccaagaacctagacaccctccaccagtaacatattctagtgagccagccaggagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattccttaaaaaaaaaag

SEQ ID NO: 721 - DNA, 2543 bp, Homo sapiens
tccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcgttgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgtccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaaggtaggaagaggagccttgccttgagttcctaaaccgacccactgcagacacaggctctgattctcttacccagagatgcccatgagctgacattttactcatccctctgcctccaagaaggcctgtattatacgtgtcctcctgtgggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagc

SEQ ID NO: 722 - DNA, 1920 bp, Homo sapiens
aaataattaaacaagataatttaaaaaggtaaaagtgttatgaagaaaataaaacaaagtagagataataaaacagatgggatagacaaaaatggtgtgctactgcacatctctttacatctctgcattcagtgacttcatgcttgggatcggccatggtaggagtatttacaccacagaaacaagccagtgctacaaaccagtgctataaactgggctttcttccctctggacagctagttattaaatgttaaccagcacactactgagtgaaggtcattgactaaaggcgagattctgacatttagtatagagggggtaggaagaaaacaaatggtgactgagcattgctttgtgatagtcattgtgccacatgctcaatttatcttctttatctaatatttataaaaatggtgttagaggcagtattatcctcattttattggtgaaaagaccaaggctcagagaagttgacttgtaaaaggttacataataaactagggtatttgatttgaacccatttctctgactctaaagcccttttttttcctctcataccaagcttctaacatttaattgaatgaatttatagcattcagttaaaatgaggttgactataatactctgcattgtaacactcagaaccaatttcatttcattgatcgtggaaattcagaccctctttcctgcatacttgtcatcaccaggtataggtccttaaaatataaacttctgggtccatagcccatcagaactactaatttgttacctgctggacgggaaaggaaataatctttacattgtttttggtagtggtaggtgttttttttgttgttgttgttttgtttttttcttttttttgtcttaacaggtaagagatggtaaggctaaacttcctaaatcataatgcaggaaatttgtcatgattgtttttaaaatcacatgttcaagtgtctagtgtctattatagttgagtgtttgaagatagtggaaaaatagatgttattcctctaatttcaaacgcttaagatatgttttcagaatctgtttgaagttaactataaagcttgagttcccaaactatttttagtaacaaagacatgagtttgaatatccttttctaggcaaaaagctcatttccaatatactgttacatctcttcttcatatcggaatagtgtagtttatgttacagatttttttcatctgctgagtaaacttgggcatgcttttgactaaaggcatttgaactggctgttaaattcatctctacagttgtcctgccatatccacagggaattggtcccaaaatgtccacggacaccaaaattcatggatgctcctcaagttcggcagtctgccctgaagataggaaaacgtcctatacacacatacaaaaggtcagccgtctgtatctgtgggttccacatcctacaaatgctattatcttccatcccagttggttgaatctgcaggtgcaaaacccgtggatacagaagcccgactgtatttcctttttttctgagacagagtcttgctctgttgcccaggtgggagtgcagtggtgcgacctcagctcaccaccacctccacctcccagattcaagcggttctcctgcctcagtctcccaagtagctgggactacaggtgcacaccaccaatgcctggctaactgtctcactttgttgccgaggctggtctcaaacccttggctcaagtgatcctcctgccttggcttcccaaagtgctgggattacaggtgtgatgcatcacacctgctgtcttttattatataattttcctacctccctgaggtttatctaatattaatacactgtcagagattcctaaaagataattagtgcacccaaataagaaggtatgtaggcctacacaaataaaatggaaatatctaaaatg

SEQ ID NO: 723 - DNA, 2286 bp, Homo sapiens
gtagtggaaattaaaaagggagaggagaaaggaggtgtttcagtgtgttctgcaggtccatcaagtggggcctgtttgagcctgttaatttacatgaacgggttaactaaatttgttccagtaaaagaattgtgcttgttgaatgtgtgaatgtagatgataaattccatcttatagccatgattaatggaggaataactgggatttgtggcaaccgtttttaggtaatttattttaaaattgtagagctaaaaaattgtaaaaagttttattttccaacagtgattttaacctggtattttatatttaactttctgtgtgtgtgtgtttgtgtatatgtgtgtctacttgtcttaatgtgtgcattttatgtcttgtgctggtggagtttgtggagggagattaatgtcagcctgttgttagttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggctcccccagctttgtgattggacctgcaactttaccccatctggcccacctacctctcttctggactgtctccagatccccttatctgccaagttttgtctccttcaaacttctgaactcttgggcgtgtgtagcagtgagcctctttgcaaagggttcgtttcctcgggcactcatctttactgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaacatgatacaggaaaatttagtatgtaatccagtaaatatcctaagttatttattttcatgtgtgtgtgtgtgtttaaatcaagtaacccttttaattgaattttaaaatgacagcgaattttgacattctgagaaatggggattttgagatgtttctctccatatctccctttgtcctgtgtgtgtggccgacgccctctggatgaagaggctgtagccattgagctccctgtgggggcctgtttcatctcgaggggactgcgtttgctctgtgtggtttgagagaagctgctcttctctgttacttcccttctatgaaggtagaagctttcagtgttacaacttctgatggcggaaaatttagtttttattaataattccttctttgatagtctagtgaactatattaatagaacagtgtactgttcacagaaaagaacttgtagggagttttttgtagtgatatgctctattaggatacagaacaatctaagagtaagcttgatagacatgatgtgacttcacttaaatggagtagagtgaataatgtaaggacactcacctctgttgaaattggtgatttctgcattttgtagacctttgccctctaagtttatcatcatattatctgttgaatctgaacagcatttgaagtcctctcaaagagtttgagctttcaggattaggttcccctgtgagtctttcacttgtgtaatggtaagtcaacattgatgatctttctaaggaaatcagatttacaaaatgctgagccgcttgatgtctaagtgttggtggttcttgctgttgctttgctgttccatgaaagcgctccctggctgcttggagggctgtgcttttccaggtcagtgccagcttggctgtcccaggccgtgcacagtgcccattgctatagctgggcccagtcctggccacgccggagcctcggcgggggcagctgggttgtcacggcagcacagtgcacatgcagagaggaccaggccatgtttttcctgtgctgagaaactcttgggttatttaatttttccaatgtgttttcataactcatgattatgtgaaatacacttgtgttagtaactgcttctataattaagtggtcactgtaaaaaggcaaataacctatttttatatcagaatgtccaaaactcatgggtttgctttgttatagaaaaatgtgccattcatttgttgggtagaataaagttgtcttgtaattgt

SEQ ID NO: 724 - DNA, 2821 bp, Homo sapiens
gcttaggcagggcctgcgcccagtttagaggccaatgcttctcccgtcctttgcatggcacccaagaaggagaaaggaggaactgtgaacaccagttctaagatatgggaaccctcgctcatagctgcacagttcaatcagaacgattggcaggcctccattgcttttgtggttgggaaccagattgaagatgatcttctcatccaatcccttaccgtggctgtccaggtccctcagcgtaaactcttcagtatggtgtcgtggcaagacattctccagcagattaatgaaataaatacacttgttggatctgcttcatctaaaaaggcaaaaaaacctgtaggtggtaatgctcctttatattatgaggtgttaacggcagcaaaagcaattatggatagtggagagaaattaaccttaccactgatagggaaactcttgaaatttcaacttctccagattaaatttaaggaccaacagcgacgggaaaatgaaaagaaggtaatagaagacaaacctaagttagaaaaggataaagggaaagcaaaatctcccaaggagaaaaaggctccaagtgccaagcctgccaaaggaaagggaaaggatcagcctgaggcaaatgcaccagtgaaaaagaccacccagttaaagcggagaggagaagacgaccacaccaatcgttacatggacgatgagccagatgatggtgcccaacattacattatagttgtgggctttaacaatcctcagctattagcaattatggctgagcttggcattcctataaccagcgtgattaaaatatcttcagagaattatgaacctctgcagacacacctggcagcagttaaccagcagcaggaagttcttcttcagtcagaagatctagaagcagaaaaattgaagaaagaaaatgccataaaagagcttaaaactttctggaagtacttggaaccagtcctgaataatgagaaacctgaaacaaatctctttgatgttgctcgacttgagtacatggtcaaagcagctgattttccttctgactggtcagatggtgagatgatgctgaaattgggcactgatatttttgaaaatattgcctgcttgatgtatgacatcctggattggaaaaggcagcaccagcactatttggaaagcatgcagcttattaatgttccacaagtggttaatgagaaacctgtattagaagccatgccaacttcagaggctccacaacctgctgtaccagctcctggaaagaagaaagcacagtatgaagaaccgcaagctccaccaccagtgacttcagtcatcacaactgaagtagacatgagatattacaattatttgctgaatccaattcgagaggaattcatttctgtgcccctgatactgcattgtatgctggaacaggttgttgcaactgaagaagatctcgtcccacccagtctgcgggagccatcccccagagcagacgggctagaccacagaatcgcagctcacattgtgtcccttctgccctcactctgtctctcagagagggagaaaaagaatcttcatgacatatttttatctgaagaagaaaatgaaagcaaagcagtgcccaaaggccccctcctactgaactatcatgatgcacacgcccacaagaagtacgcactacaggaccaaaagaattttgatccagttcaaattgagcaggagatgcagtccaagttgccactgtgggaatttcttcaattccctctacccccaccatggaacaacactaaacgtctagctacaattcatgagcttatgcacttttgtacgagtgatgtcttgagctggaatgaagtagaacgagccttcaaggtgtttacttttgagagcctgaagctctctgaggttgatgaaaaagggaaactgaaaccttctgggatgatgtgtgggtcagattctgaaatgttcaacataccgtgggacaaccctgccagatttgctaaacagataaggcagcaatatgtcatgaaaatgaatactcaagaggccaagcagaaagcagatattaaaatcaaagacagaacactatttgtgggtcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctccggagcagaccacaaacaatgagatcaaagatgatgcagtcacaaaggctgattctcatgaaaagaaacccaagaagatgatggtggaagcagatttagaggacataaagaaaacacagcagcgcagtctaatggactggagttttactgaacattttaaaccgaaagtactgcttcaggtccttcaagaagcccataagcaatataggtgtgttgattcttactaccacacccaagaccactctttacttttagtctttcacaatccaatgaatagacaacgtttgcattgtgaatattggaacattgctctccactccaatgttggattcaggaattatttggaacttgttgcaaaatctattcaagattggattacaaaagaagaagctatatatcaggaatctaaaatgaatgagaaaatcatcaggaccagagctgagctggaattgaaatcttctgctaatgccaaacttacttctgctagcaaaattttttccattaaagaatctaaaagtaacaaaggaatcagcaaaacagagatatcagatcaagaaaaag

SEQ ID NO: 725 - DNA, 1876 bp, Homo sapiens
agccttctgcactcacagccgaagggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcaggtgagggacatgttcggggaggacgtcctaaaatggatggtcatcgtcttcaccaggaaggaggacctggccgggggctccctgcacgattacgtgagcaacacagagaaccgggccttgcgcgagctggtggccgagtgcgggggccgggtctgtgcctttgataaccgggccaccggccgggagcaggaagcccaggtggagcagctgctggggatggtcgagggcttggtgctggagcacaagggcgcccattactccaacgaggtgtatgagctggcgcaggtgctgcgctgggcagtccctgaggagcggctccggcgggtggcggagcgcgtggcagccagggtgcagaggaggccatggggcgcctggctgtcggcccggctgtggaagtggctgaagtcccccaggagctggaggctgggcctggccctgctgctggggggcgcgctcctgttctgggtgctgctccacaggcggtggtcggaggccgttgcggaggtcgggcctgactgacagcgcaggtcctaaaactgaaggcaacttggttaagggaggctgaattcttggagctgaagggaaaacttcattccaacggaaggaatcctgtagtttcaggcatagttttaatgacacagaaaactttgctgcatcacctttgcaactttgccaaagctcagagttcactttttaagtttttaactcattttaaatgatgtgtatgcagagttttaaaataaattcgtctaacaataacttcctttggtagttttggtagtctaatgtcaagtagcttgtagtggggacaaacgcatggcacagggaaaacaagtgccattattttcgagctttttaaaaaatttagactgcccctccttgataattttctagttcttatacatgggtagataggttcctttgtgatccttgtagacttttagcatcaataaaagaaatgtgggggttacacacgtgaatgttacttctgagacatcagtttatagtacaatgatttactaccaaaaagatgaatgtaactgtactgttacaaagtggaaaataacagtttccacttttctagaacatattatggttcatggcattccaaaatgaagtaagggccgggcgaggtggctcgcgcctgtgatcccagcactttgggaggtcgaggcaggtggatcacctgaggtcaggagttcgagaccagcctgaccaacatggcgaaaccccatctctactaaaaatacaaaaattagccaggcgtgatagcactcgcctgtaatcccagccattcaggaggctgaggcgggagaatcacttgatgcagtgagccgagatcgtgccactgcactccaggctgggtgacaaagcaagaatctgtctc

SEQ ID NO: 726 - DNA, 3293 bp, Homo sapiens
cttttgcagatctgaagagcacagtcaagaccacagacacccgtggaggctcccccaagacatctgcttctctgggactggggacctcgctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctcccatggagagctcagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggtgagttcctggacctcagggaggaagacggggatgaaaggaagagaggggccaattgggcaggggctcagtcctggcagcgctatatctcataagctttggttgcctgcatgatttttaccatatgcatctccctcctgtacttttacgtaagcagtattttctttacgtcgactctcattgttttacttgaataaacatctttcaaaaagaagcactataacgcgaccacaaatggaaaacccgcatcacttgtcagaaacagaaggcggaaagccaggacctccggcatgtcatcattcccttgctgcacactgtaatgccacaggaatcacagaagagctctaccagagaatctatgccttttgcacaaggttactgaccctgcccaccccctactgcacagtcgccttggactgcgcgataaggctgaaaacggagatggctgtcccagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggtgaccttgtccaagagcggccaccaagcattcccctgcccagcccctacatcaccttccacttgtggaccggtgaggagcagctctggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatgcctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagatggcttttcacccaggaggagaggcgtggctgagggcccaggggcagagctctccctatgctaccagaaggccttgcttagccaccggccccgagaggtcaccgtttccctgcgggccactgggctgatcctgaaggccattccagccagcgacacagaagtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagatgcctctgcatacactcagcctgcagcctcctgatccagtcccctctgcaggcacgggcccctcccacacaggctgacctgtggcatctgcgttccagttagctgacccttactggcttcccctcgggaggtgtgtttggattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtgagcctgcagggacagcaggcccaggaggaaggatacactaccccaccaactccaaacactcacaccaacagccagagcaaggcccggctccacacggcagctttggccttgaccaggagccagcgagtgcctgggagcacagggagcctaccctggggactgtgatgaggaagggcccacatggaggtctacggatggcccaggcaatgctgtcgctgcttgagaacatacacaccaagcccagcttctcatacaaatgtctactccttcatttagcttcaattcccacttttcccactgtcctctcccacccaagctccccatccagcccttaaaaccagggttaaagctgctgtcttggccagagccctgtggcctaggggaaaattggaagcaaggaacagcaacagcaccacctccctcccaagtctcttcccttcccactctcaggccactgcccacctcactcagcccaggcaggtgtctctatcaggtgagagaaaaatgtcagactcaataaatgtacactgaagtctttctgctttcatctc

SEQ ID NO: 727 - DNA, 2124 bp, Homo sapiens
tgagtatcttttcagcaacaccccactctactggtaccaatttactgtattagcccattttcatgctgctaataaggaaacatatctgagactggaaagagacacagaggtttaattaaacttccagttccacatggctggggaggcatcagaatcatagtgggaggtgaaaggcacttcttacatggtagctgcaagagagaatgaggaagaagcataagcagaaacccatgataagcccatcaaatcttctgagatttatttactatcatgagaataacacaggacgacaagaccccatgattcaattacctccccctgggtccctcccaccatacataggaattctgggagaaaaattcaagttgagatttgggcggggacacagccaaaccatattactacagataaataggaagccagaagggggatacagtgaaaaggtggttttcccctggagtcaggctgctcagtggctgaactatcctccaacaaccccagccaaatttccttcattgttagtgtccttctgcatcttgatggcctgccagtgactgttgttgtgctcttccattcctctgctcctctcagtgtccagccacctgtgtgttcttctgctagtgtgttcttctaaacatccagccacttgtgtgtgtgcccactagggtctcagggttattataggcacaggatggagggcatggctggacatggtgttcttgggaaatgcaatatttgggcataaaaacaggagtgcctgtcctgacctaggtccattgccataggccagaggatggagagacctcaccagagaccaattttttctatccagcattaccgtatctctctcctatatcatttgcccttcctgaagaggtacatctaattgctgttagaatttggatgaccaccagtcttaagctacttcctgctgacagggaaagcagcagtcagatttctcccagatgtctatctaagggttcctagtaagtggagccatcatctgaagctcccattgtctgaccatttggaattttgtggctgctaagtcagagagaaacacgttttatacagttatgtatgcataggttaaacatgtgtattgtaaaaggaaataatttattgccaaagattacagagataagaagtgaaacgtactaacagaaacattttacctgagttgtttcaccctgacaaaataaattaaactttgtatggaggtagttaaactttagaagataaataactgtttttgccatatctttaacagttaccaggtgcaccctgggaattctgaagtttgtggggattacttggcagccattaagtcttcttattctttcctgttttttctctcttttctgggcctctccgtttttattataaaatacaatggtggctatttcaggaggttctctaaagtactatccagatccaggacctgtttttgtagcttcttctgataccagaattggtctgggctagttgtccctcaactaagttaggagataaagaggggcactttaccaatgctccattaccttaacagtaaggcagtgggatgtttatcaaatccttggtcaatcatggacaacttagtataattaagtggcttggtactagttctacataagcctttcattatacacacttgaaagtgtctcctcttccagtctttcatcttgtcattgggatcccatttagggtcatccattggtactgcttctattccagttggataatgtttttccccttcccttatgctatgtgttatgccaagctcatcctcaaatttctctgttgcttacagagtgccctatttctcagtgtccatcagggtctgattcaaaagtaacttaacatcggccgggtgcagtggctcatgcctgtaatcccagcactttgggaggccgaggtgggcagatcacgaggtcaggagatcaagaccatcctggctaacatggtgaaatcccatctctagtaaaaatacaaaaagttagccaggtatggtggtcagtgcctgtagtcccagctactcaggaggctgaggcaggagaatggcatgaacctaggaggtggagctttcaatgagccaatatcgcaccagaacgagaccccgtctcc

SEQ ID NO: 728 - DNA, 2133 bp, Homo sapiens
gtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagatgatatgatcttttatttggaaaaacctaatggctccaccaaaaaactattagaactgataaacaaattcagtaaagttgcaagatacaaaatcaacatacagaaaatcagtagcatttctgtatgtcagcagcagacaatgtgaagaagaaatcaagaaagtaatcccatttacgatagtttaaaataaaatacctaggaattaaccaaagaagtgaaagatctctacaatgaaaactataaaacatcgatgagagaaattgaagtggactccaaaaattggaatgatattccatgttcatggattggaagaatcagtattgttaaaatgcccacactgcctaaagcagtctacagattcagtacaattcctatcaaaataccaatgacattcttcatagaaatagagaaaacaatcctaaaatttatatggaaccacaaaagacccagaatagccaaagctattctgagcaaaacaaacaaaactggaggaatcacattacctgacttcagattatactacaaagctatagtaaccaaaaacagcatggtactggcataaaaacagacacatagaccaatggaacagaatagagaacccagaagccatatatctacaatgaactcatttttgacagatgccaagaacatacattggggaaagaacagtctcttcaataaatggttctgggaagactggatattcatatgcagaagaatgaaactagactcctatctcacaaaaatcaaatcaaaatggattaaagacttaaatctggccaggcgcagtggctcacgcctgtggtcccggcgctttgggaggccaaggctggtcttgaactcttgacatcatgatttgcccgcctcggcctcccaaagtgctgggattacaggcgtgagccaccacacccggcgacttcatccactgtctgtccgcttcctgtgtaaggccgaccacccagcccccaaacaacccttaaaatgagacccaaaccaaagacctaacatataagcctcaaatcagtaaacctctcctgaaacaggcagaggaactgcctgcccagaaatactcacaataggctgtgcagattgtaaagagatcaacagcttcacccacgctctgcataaactctggtactggctgtgttctccatagaaggtctcgctgtgttgcctgggctggagtgcagtggtgtgaacacagctcactgcagccttgatctcttgggcttaagtgattctcctgcctcggactcctgagtagctgggaccgcaggtgcatttcaccactcagctggtttttagtttttttgtagagatgaggtctctaccaagctggtctctaactcctgggctcaagcggtcttcccgtcttggcctcccaaagtgctgggattgcacatgtgaaccactgtgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagaaaatatttgcaaaccacccatctgacaagggattaattaccagaatatataaggagctcaaacaactctat

SEQ ID NO: 729 - DNA, 2255 bp, Homo sapiens
ctttcggagtggagtttcctagctggtgcctgtcctctcttgagcctttgtttcttgagtgagcactcactggggctgtggctccatgaactggatttcaggaaaccagccaaggcattctctctctctctctattcctagaaaggcagaaagcctgggaatgggttcggcaggaagatctctgtacctcaatctccattgctttcagcaccactggctttctccccagctcaagtgcaaaacctgtcatcgttgctacctggggtgcctcagactcacccaagtcccccaggccagaggacatgctctcaagccttgtttcagaaagagggacccaaaggctgttagggaagagaaccagggtcctcaaacccagggttttctcacccactgcctctgctctggctgtggcctgccagacctctcctctgattttcgctttccttcctgccagtgcctttgtttatccgaggcgccaagatcccactgtgaagtctgaaaggaagaccagtggttctcgcttttcctctagatgctgtgtctcccaatgtcatcttctttcctctcaaagacaattggacgttgttacagattttcttggaatgagtaaatacctagcagtgggattgctggatcatatgaaaatgccagactatatttcatcagcaacatcggagagttccagttgctctacaccctcactagcacttaatattgttgatcgctgcctggattcacagaaggacaaattacaatgcattttgaaagactcgtctacagtcaactaaaataccagttatcacagacttcactggccttaatgaggaggctgagagggatttaattactgggacatgcaacgcttacaccaaactctgttcgattcacgacttggaaaagcaaatgtggatacagatgagtgtggacatggcttcagtaggaaatgtcgagtttgttcatcactctgaagtttcttcagctgcaacggaaactgcaccctccctcccgacttgttggttatcttgctgtgctcccaagaaggtattttctgctgacctgatagatcagacctttgtcattttgattgaaaagatgtttacctgttggtccccagcctcactcttctgaacctcagatccactgagtgtgtatccagaggtaagtatgtggtaagtatgcttgtcatttacattatctgtcagcatgagtattggtttcctagaaacctaatattgaaaacacttagcattgctaaaagcattaaatgaaataaagactcaatatagctgcactaatctgtgctttctaaatttactgatggacgtgaagaaagtaggttggcatggagtttatacaatttatggatcacactgatctgaattcagacagtgtgtgctcagataaaaatattgtttcctcccatgaggtttccaattttgcagagaagaatacctctgtttagctcattacttaacacaatgggtagctgggtggccttgcattctggaagtgaaatgacacaagaatgtctccactgcattctccagaggtaaagattctctggcacaaaatcacaaccaaggtggggttccaaaactatagaacaaatggcagcagccatgcagccagccttggttcgggtgggctgtaaaagcagaggttgtcctcgtgttatcagcactgacttcctgttgtggccacactgacagagatgagatggcagaaagcaggaaagagaccagagctgcaattgacagatggctggccaaagttgaagggtcagagactacaccaaagacttctcagaaaatacttgcctaggaggctctcacttggaaagatattcagggttgttaaacatatcctgttattaggaaaacgagagttttatctttctcttactcagaaagaaaaaacaaaaagaaaattagtgctcttaagaaaagctattttaatgttatccattataaaattagaaaaccttgaaaggcaaatgtttcttctgaccatttacactgagcttctttcattatctcatatgcaaccttgtggattgaaggtggagagtccttaggattacccaggaacatccctgtctgctccccctgctaggcaggaggagatttgaaaccacatgtgtctacttcatttctgtcacgggtaggacagtgtcatatactttgtaggtaactcaaagatattataggtaactcatagatattgattgaattaatgtttaataaaatgagaacacc

SEQ ID NO: 730 - DNA, 2415 bp, Homo sapiens
ttggctgtcaaccgtttcctctgctccaggaagcatttccagacccatcccaggctagctcagatgtgccctcttgctgttctcacactgtattgtgtgtatccatttcgctcactaaactatagcttgaaaagcaagatgagtgttaaaacgtatgtgttgaatgaaggaatgatgaatgaatgaatatatgaatgaatgagcgaaacatttttgaatagtcctgccagtgatgaagtcaaggaaacaagctcagggaatgcgatgggcgctgagactgatgataacttgctatgtgttcttttttctgcccttcctcctttcatttcagggtttcaaagccagaggagataaaagaaatttgttccccttgcaaagatgaaaatcagatttgccctggttttggttaatcgaagtattgatacgtttttccttatttaattttattttttaattacctccagttccatccatgttgctgcaaatgacaggatttcattctttttatggctaaataatattccactctgtatataaaccactttttttttttttaagacagagtcttgttctgtcgcccaggctggagtgccgtggcacgatttcagctcgctgcaagctctgtctcccaggttcaagtgattctcgtgtctcagcctcctgagtcgctgggatgacaggtgcccgccaccatgcctggctaatttttgtacttttggtagagatgggtttcaccatgttggccaggctggtcttgaactcctgacctcgggccgtctgcccgcctcggcctcccaaagcgcgtgagccactgcgcccagccagtttttcctaattttaggttggaatgcactccctgaacagcccctgttcatccaaatccagccttcgaaaatctactcctttttcctccatcaagtcttcaaacccatgaagatttgttgtccctaaatatttctcttagagaagcacattataaccaattggctataatgaagtattctggaacgatcaggatttgctgagtattggagaaagatccatccacttagaagaagaattaaacaatcagaagtggacacgacctggaccatcagcccagcactccctcttctgggtgctgctcctctcacatcatccacgtggttccccggcagcagccacatatgcacgatgtgcccacccccagctgaagacaacattatccaagttaaaccaaagagccccttctccagagaatttgggattggggccaagagattccatccaccaggctgctttcttgaagcaaaagactacaccccacaatgtggggtgaaagaggaggaagcatgtctatagagtaagaataaagcagatattcaggaaaagcaaagaaagaagtaaaacaggggcttcggggctccccacaacactccagtccctgtccttgagttctgtgacaccccagtagcctgataacaaattctccccaatgcccaagcaagctcaaatgggttctgccacctgctcccgagcatcttaacaaatgcgccaccgagccaggatggatccctcactaggcgttgaagccaataagagaatgcgccgacacctgcctaatgcagctgtgcactgcacagtggcccatcaggtcccagcgtcctgctggccttcagccaaagcagaggaggttagttgtctagtttcttaccggcaggtacttggctcccccgacggagatcagcccagccacaagacccagcaccatggcaagccacggagaagggatcaggtgacacgaggtacccacagccacgcctcctgccaacaccgcactgtgcacataagtctgcaaagaaatagcgtgtgggtaaaggaagcaaggtagagagagaacaccatcttgctgcaagtgaccagcacgctgggaacaaggcaaccctgtaacatcctccctgctttgctgatcctgaaaccacttctcccctgtgttggggctacgtgtccttcatcagtggacatgatgggccagctcactactgcctcttaggctcagggcacagttaccctgattgtgcagcatttagggaatgagctgggaagtccaggtgctcagcatcctaggcacccatcacactcattagtggtgtgtccctgggcagcgggaagaatgggtttttgttttattttttagagacagggtcttgctatgttgcctgggctggtcttgaactcctggcctcaaccaatcctcttgcctcagcctcccaaaatattgggattacaggtgtgagccactgcacctggcctagaagaatggggttttggatgtaccttcttcataaggttattgtaaggattaaatgagtttccacatataaagctcttagcccagtgtctggcatagaacatgaataaatgcccagtagacac

SEQ ID NO: 731 - DNA, 2173 bp, Homo sapiens
tgtcttaggcagtcacttaaaatcatgtttccaaccatttttaatgaagtggaagacagaatccatagtgttctgcttgcacaagtgctaattccttgagcctgtttctctggacggtggttctgtcattggttgtgacagtactttctgcacagtacgtatcttttaatgtagtacagatattttaataaaaagaataaaagagatgctccaaaaggtgtcttttttttttttgagactgagtcttgctctgctgcccgggccggagtgcagtggcgtgatctcggctcactgcagcttccgtctcccagcttcaggcgattccctgcctcagcttccccggtggctgggattgcaggcatgtgccaccacaccagactaatttttgtgtttttggtagagacagggtttcaccatgttggctaggctggtctcgagctcctgacctcaggtgatccgcccgcctcggcctctcaaagtgctggaattgcaggcgtgggccaccgtgcttggcccgaaagttgtctttttaagaaacttcaagggaggaccaaggcctgcgattcagtgtggagcagggaggatccaacaggcccagccctcagggagcatagtcagaacggggctgggagcgggatttggggcttcccctcacctcccagggcctccatctctgtgctcctgcagacgagggactatgggacatcctcatcaaagacatccccaaggaggtgagctcctacacgttcagcatggacatcctgaagccgggcgtgagctatgacttccgggtcatcgtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccgagcatttggtttatttagaaaaaggaagaaaaacaaaaaac

SEQ ID NO: 732 - DNA, 2886 bp, Homo sapiens
attaactgaatcctgatgaactgttatcgtctcatgttttatatggggaaactgatgcgcagagaggttaagtgacttgcccaaggacacaaagctagtaagtgtccaaaccaggataactgtccggctccagaagccacacagtaagccttgatcctgtgctgcctcaaagacgggacagctccctctcaagtacgtgttggggctcaggaccagaggccctaggattgtgtgccaggtccaatgtgctgtgtgaccctgagggaagtgcctcaccctgtctgggcctcagtttccccatcaagggtgttagactcaatccctgagcccctttgaatgctgaggttttgggggtctgtgatgacaaaagttggggacagaggatggaacacccttgccttggagcccattgagaagccacattcctgggggagcaggggcagagtctgggctggacactgtgaccaggttggggtctgggtccccaagtttgtctgactgctgtctcactttgctgccaaggcaggttagggtggcatccagtcactgtgtggccacgagtcggctccagagacacaggcccagggtgaggtggaggccagagctcctgtgaactcagtgcccacaacccaggtgtgagcgcacagaacctccgcgtgctgcacctgggcaggagaggcacgtgtgtccccagcagaggccttgtgatgagaaccagtcctttctctgccacagagactcagtcttgctctctctctgcctccattttcttgtcttcaaaagcgggttccaactcccagtctcacacggtcattggagccctttacacatccacggccttcccagctgttaacatgggctggtggggagaggaacctgcctgggcagggctgctgggaggcctgagctgactctgccctcagccccaccaccgcatcctaggcctctcctctgcgaggctgggaaggaggatttaaaaagaagaatagaccccctcctctgttctgttgctgctgtgggggggctcccatggcccctcttggcccggggcacgctccaaccagcttcccggcaggtctgtgttcggagtcctggcgggggaggccccgggcagcctagggcaggaagaggagagccaggtctagaactaggggtcccccagatgggccttgggaaccagagcccaaggtcattcttcaggaagccctcctggggttgtctcgagctggaactgacctcttccctgctgtcctccaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctaccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtctctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaac

SEQ ID NO: 733 - DNA, 2072 bp, Homo sapiens
acttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagcttagacacaaagcccaggtgcctggacactctgatgaccacagattccaggtgcagcccaagaacaccatgaaccccgagaatgagcagcacaggctggggagcggcgtgagtgtgcagccacctagctcaggggagagggcagcaccagagaccccaagcctagggtctcatccagccagccctgtgtgccccacagctgcagggggaagtgaagtgggcgctggagcatcaggaggcccggcagcaggcactggtgacgcgtgtgtgagtggccatctcacctggggccccatcctggagcagagagaacccctgatcgtgggcctgctgagcctcacccccgtgtcttcagggcaaccctgggccggcagctgcagggagcccgagaggaggccagggcagccgggcagcgactggccacacaggctgtggtgaggctctgccctgactgcttggagacctggagggtgggggccccagaagctcagccggggtccactctcagggcacaggtggagggctgcttccaccccaggtgctgtgcagctgccaaggccagctccgtcaggcagaggctgaaaatgcccggctgcagctgcagctcaagaaactgaaggatgagtacgtcctacggctgcaacactgcgcctggcaggcagtggtgagccctgcaggagcaccctgaggcctagggagcccaagcctggcctgggtgtgctggatagcttcagggagaccccagggccccggcactgctcagcctgctggggtggggggatggttggaaaagatggggggtgggccccatgcggacccagcccgccgcctccaggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacagggcacctgggaacccccaagctatttttgacatagccagcttggacctggaaccattgcccgtgcccctggtcactgacttcagccatcgggaggaccagcacggcgggcctggggcactgctctcatccccaaaaaaagagacccggtggagcctcccaggggggaacatcagagccacagggcctggacgctgcatcctgggcccagatccaccagaagctccgggacttctcccgcagcacccagctcatggcttacatccccatgccaggcagagctggaacgggagcgggcacagctgctggtccgggccacgatggctgaagagcaactttctgagctacaggagtacgtggaccagcacctgggcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatag

SEQ ID NO: 734 - DNA, 1498 bp, Homo sapiens
acccactgcctcgaaaggcctctgggggtggtcggcgcgcccctccccacctcgcgggggccgtgtgggcgtcgctcggtcgttggggtgccggggacgtcgtgatgagaacggcgtcccagagacggcggtgacagagccgggacacgtgacagtcacagggtcacattctgcggtccacgagtttgggaccgggctggtcacgtgacgcgatttccgttggaagatgcaacggttccggtgacggtagcaagttctcgcgtccaggcatctccgcttccgctcggggcgcaacaacttccgactccaccttcccagcctcgggcaaggaagagacgcgaccatggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcggcaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcat

SEQ ID NO: 735 - DNA, 2303 bp, Homo sapiens
tggcttgtcctcttctgggtgggggctctgaatggaccccaggaccatggaccccagggaccccctgccacactggacaaggtgtcagtgaccactccaggtagaacagcaatggtatctccacataggaaacaccaagcctttgtgaccacatgagccgcagcgtcttcatcatggatgaggaagggaaccagttctggaattcgggctcagggaaggcataaatgttggctgactgtcaaatgcttgtgggaggtccccacggagtggagaagcgggagactcagcttaatcacagacaaagttgtgcatgagagacggagtctcactctgttgcccaggctggagttcaatggtgcaatgatctcggctcactgcaacctccgcctcttgggtgcaagtaactctcctgcctcagcctcccgagtagctgggattacagagtctggagtgaaccgaagactaagcataaatgctgcaggtcaggggctgtttcttatgcctgaacatcgcggggccttggacaccgtctttccaaatcaagacagcatagagcacaagtgctcagagggaatgagcgaggatgcagctggctgctgcctctcagagtcacagttggtgcacggaccccagcactaacaaacggccaccaggacgctcctctgtgtgcatgggctcatgtccctgaccacgaaaggctcagaagacgcacctttggcctggtgctggctgtagccttcggggcatctggaacctgaagtccttccttgaatgctgcaaaaataatctttgcagccaaagtcaggcccgcctcggcctcccaaagtgctgggattacaggcgtgagccactgcgcctggccgcaggcatgttttttttaaaaagacaaagcatgtaatttttatattagtctcagtttggtcagagaaaatgactggtctgttgctatcagcctcagttactatgttttattttttatttttcttactagtgcattacagttaaatagaattttattgaagaagttattgggctgaaggcagatcactgtaaagcagcccccatcactggcatctggtctcagtgtgataaatgctcaagaggagaagaaccttcacagggccaggaagtgatgatgtaggttccctacctgccggaaggcgcaacatctctgcccgcaaaagcagatgtggaagttgcccctctgttctccagtctctctcttagaagcagttatcccctctcaagctccttatttctaacccccccagccagtcccaggggagggcaaatgctaaaattccaaggccatttccctgggagaagaaaggagaggtgagcaggaacagagaggcaattatttgattgtggagacccgcaaaacctatgaactatttggggtccccatccctagtgtcacctaccctagggagatgggtgtggaaaggaagactctttactcgctcattaccaaatcgtgcagttagtcaagttctccgcaaaatcatatcaactttgttaagagataggaattaaataaatgtctaagtatttctctgtgaccgtcttttagcaagcaaccttaaaactgggtgaattttggggatccagcaaccaattctgaaaaatttgatgaaaatctgatttaaacaacttttttttttctaagtgtctagacctttctgtatcagaaatgaaagtttatcacagtgtctttttcgagccccagtcatttcaaggacacgatgagaaaaagctaatgcatctctcctgctcttctcactactcaagctcaggaaaaactgcacccggcatccaaagagtgggtgggcttaaggatgtaaagggtccaaccttgacgggtgggacagcgactggctggtgaagtcacttagctcttgctctagtctccaccagggtgacaccagccagtcgtctggccattcaggcacttgtttgtcctgctcttgctaattgggttggcatttggcttgtcaccaggtatttgggatgctcgcagggaaagtgtggagaaatacaaaccatcaccttaataattggtatgatatttcaggatctctgaatttcttcctttgtgtgatatttctggagagaaaaatccactaataaacctttttaaaattaatattaatgggcctcttaactgtagctaagatatgagagtatctttctctcaagatggtcactgtaggaggctgattaaaaacactttgacttcgtcagacagaagggagtattgtatcttgcatgtcatcagttaattaaacttttcagcatcatcc

SEQ ID NO: 736 - DNA, 2801 bp, Homo sapiens
gcaatgctcctcccgcgcagctcttatccccgtagactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagagtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggactggatggagggcctgaagacgtgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattttggttttctgtctgaagagtatcccagtatgtacctgtggagcagcttctttatcccttcatctgtggataagcagtgcaggccaaggccccctgcccatggaggtgtgctgcagacagcagcagcagcagcagcagcagcagcagcagcagcagaggcctggcttcctgaggaattgctggccggtttgaggaaggaaggaagtcccacctaccatgatcaccctccagcctggaggaagctccatgccagcagcatggaccagcatgggagccagagccctgctaatgctgcagctcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaagtctggagaaacagctacggccatcccagccctggccaaggggaaaatgccggaagactccagggtgggaggaagcgcgtcccaaggcccaggatctgcgaggcgacttggggaaaatgcaggacctgctgaagctcacacccgtggaccacccagactgcctgccgctacaggatgccctccgcatctcccaggacttctttccggcatcagtgtggacattgaccccactgggctgcagtcacagtggactcccaaggggcaggatccacctctgatgttcagtgaagactaccagaaaagtctgctagagcagcaccatctgggtctggatcaaaaactcagaaaatacgtggttggagagctcatctggaattttgccgatttcatgactaaccagtgtaagcggcagtttggctcataggataatgtacccgtcctcattttttcaggttgccttgcccattctggacactttgattgtaagaatattggaaacaaag

SEQ ID NO: 737 - DNA, 2134 bp, Homo sapiens
agacgcgggcctggactgtctagactgtcctgtctaaagctttctgaatgcggtttttggaggaatcgcgctagtttataccttttccaactcttctaactctggacctcttcttaccgagcttgttaggtgaaatcaggctgactgtctcttgtgcccctcgcctgtcctgtccaggaatcccagttaggtaggggatggggaattccttctgctacactgcagtatactgcatgataaacacaggaactcaaatggatttagaggttaaaggagttgctgccacttctaggagccaaattcagccattctttggaagaaagaagcctctacaacaaaggtggacttctgagtcatggacaaaccagaattcttgcccaccagtggtcccacgacttgatttgggaagccttgttgactctgatgatgaggacaatttttcatatattccacttagtacggcaaacctgccaaattcatcttctactcttggctgggtcacaccatgtcaaactccatatactcagtatcatctaaataaattggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggttgaccagcaaggacaaacatgaaaatgcttaaaaaaaagaaagcgcttaaaacaaagaaatagaaggtaatgggcatatataaaataagccaagcaagagaagagcaaagacaatctgcagggtggacatggatgtattcgtttctgatcatgagaagaggctcttgtcatacatatcgttccatttttattttaaagttctataaatttctgaggtaaactgatttcttggatgtacttaataaagaataaatgtttcatattgg

SEQ ID NO: 738 - DNA, 2123 bp, Homo sapiens
ccctatctcgggccgccgcgcctaggcccgtgagcagcctgtggctggggcatggcggcacagcccaccggcgtgcccgcgaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacagggcaggtctcactatgttgcccattctggtcttgaactcttggactcaagcaatcctcccacctcggacttccaaagtgctggaatcacaggcttgagataccatgcccagccaatttattgtgatggtgagctccttagagggaagtatagtacatatttcctccatgtctccagtacccaacacagcgcctgacgttgagagggctcttaataagtgtttgtgaaagactggtagagcaatgccctatgaaacaagaagccggataacactgcttaggactcagaggagagaggagtgtggtctacactgcacatctctgccaagcctggcacgggatttgaagttccacaccactgagccaaacacatccagaccctcttccaaggatataagaaacaggaagttgtgtttggctgcggacaaactctctcagtgcccctgggacttacaagatgtttggaatgaggaacggcagctctcccaatgcgagctcagcggaggcccccagaaaaacgtggggaggagagttttccccataagacagactgtccttcagccccggccaccaaagaggagtaacccgggcctgctgttctctgggactgaatgcggctgcatccttcccttcctctgcttcctgtcccggtacttactgacggtgcacatgcggggcttggggaagctgagtgtctaaccgcggtgcagctacggatgggaaattctgggcagggacgagcctgtcttcacctgaggaattccctcccacatcacacagggcagagtgggagtggaggagggcagaggacacgtctcagggccagtaacctaggcttatagaagacgtcatcaccgtcctcatgatgttcaccccgtctcctgttttttggggccatgtgttccgaaatgtagcttcaactcatcataggggcaaaaagaagtgatgagtctgtggcagcagaaatctgggaatccaagggtcgtgctacatttttcgagaaaccattttgaattcccaaacagcaaaggaaatgctgcaggttcctggagggacctggtgatctggggcagagcacacggagtcgagattgctgcggggttcacgagcctcccctcctgggaccaggggcacctgggcagggtagtctgcaccacgcaggaaagcccagtacacgcagctgttcaacgctgcagacgccatagcgcagggctgacaaggcctccctctttatctgccctggaccacaagtggaaaatatcaagacaaagcaaaagccagtatcccttaagaactttccaattgttcttgtcatttgtagttttgttttttggggggtgtggggagggaggggtggtttgaaacaactccggagcacactccagaggaaaacaggaagggtgacatgtttggacaccagaaaagaggaagagtcctcactaagagggtgacttggttaaaaagttcaagcacaaaggatgtagaagcaggtggatgtcatcagagaacagatgcggatctagtgagatgggtcctaccacccctggaatatgttcctgggagaggggtggtctgctagagtggactgggaatagtaatattgcatacttttgtaaattcacaaaaccctctgatctgtgatagaggaataaagggcagaggataaaccccagataaagattcacttatcttaaaaatgaaaggttggaaattaactttatgctactgtaccaccttcgaagtatttctggcaggtgcctggaggattcagattaatgaccaaattacctgccaagtcagggcctcccattagaagagagtaccagtttccattaggagcactagctggaaaacacaatctttcagcagaggaaatacagtcttctctccttc

SEQ ID NO: 739 - DNA, 2418 bp, Homo sapiens
gttgagcttgagcgtgagccggctgctgaagacttgcgaacatttcggagccagcgagagcgcgccagagagagcgagagtgagggagtgagtgcgaggggatctagaggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaagcctgaacactgatgccggaactccaactgatcataggcacgaatagggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaagcctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttg

SEQ ID NO: 740 - DNA, 2163 bp, Homo sapiens
gaatccagagaggcgctgctgacaccgccgccacaccgccgccacaccgccgctgcctcagtcatgccggtgagtggttgcgccgtccccgccacgcagacttgcagtcccgggttgcttctcggctgcacagccgcttgaccggatgctgatcttgaagggctcaggcggcggccggagccgctgttgtcccctagcttaccccacccagcccccagcttttgcgacccttcagaaaatgggatccgaagggagtttaatctgggagccaggcttcaaaacgtcggagctggaaggcctccaggggcgacaagcccacaccttccctgcgtacacagagaaacagaaccagagagggggcaggggatgggggagttggtggccagcgggaactgagacgcctagtccctgagccttcctcctggctgccctgcccgcggagctggcctgaaggagggcggtggggaggctctggacaagggagtggacccggttatttcctcacggaccgggcaggttttcagaggttcatgcttttcttaatttccctgcccactctggcctacttttcagatcaactctgggcgacactgaatggagacactttctcagcctgaacccatgagccccagagaggttcaggaacccccccgcacagtcaccagttgctcagtggctgtgtctgggaagtcagtcttagcctgcctttgcagatcactcagtcttatcacatatattgttgctcgtggcctcgttttttatataaagaattgaggcctttggcagataaaaatataaaaagcccagtaacttattccaggtcgtgttgaagttggcagagccaggattcagctccttatccttaggctccccatctctccaggcctgaccacatgggaggtgccaggcaaaagcagtcacaccggcttgggaagatgctctgatctcagttgcatcttggttagggtcatgtggtgtttagcattttcttcagggtgcctaattcatggctctgggccaggtggatacccagaggtatcccacagttgccatgtgtctttgcatcctgtctttagggagctggcaggtgagcctgaggcctcctgggcagagccactgacatctcaggtgtcatttcctgtgggtcttgccaggtgccttgagacaaatcctccaacaacaaagtatggataaggaatctgatagaatcagccctaccagttgggcaagtcagcctgtggcaatggtagaagacagtattaattgccctggggcttggggagtgaaggccaccaggactttttgtggggggtggcaatgaggaaaaggctagcttgatcatcactgtattctgtatcttctggggattttgacaaaaaaccctctggagcagatgatgggaatgaggagggcacttggcaccatgtaccacaagataacagctgaaggaaagagggtgttagtcaagggatttcctcaaaactggaaagggaagaaaaaaatatatctatatacacatactggaaggggaagagtgtgttacctgagagttttctcagacaaatgcccgagagcacagggtttggaatcccagaaacctctgaaaatctgtgccccagcttgccaactgggtgacctcaggcaagttgctttatctcactgccttgatttcctcatctgtaagatagggacaaaaactttgacctcacaggactgttgttagtattaactggaaaaatgccagtaaaatatgtcacacagccactgatatatctagtccccaagaaatggtagctcctgtgtagacgtaggacaggtgggctagagctataggcaggtgaggccgggcatggtggctcacgcctgtaatcccagcactttgggaggcccaggcgggcagatcactttaatgcaggagcttgagaccaactttggcaacatgatgaaaccctggctctacaaaaaatacaaaaaattagccagacgtggtggcccgtgcctatagtcccagctacttgggaggctgaggtgggaggattgctggagcctgggaggttgaggctgcagtgagccgtgatcgtgccactgcattccagcttgggtgacagagtgaaagtgaaaccctgtctcaaaagaaaaaaaaaaaaggaaggaaggagagag

SEQ ID NO: 741 - DNA, 2236 bp, Homo sapiens
agcaatagtgacctcattaccaaggggtggcgaccacattaccaagcgcaattccccattctccaagggctgagaacttcggtgagttcatccacctgtctatttgcacatggaggacttttcaagatgtcaggatgcccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgtttgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctggttctgcatccaactagctgtttcttgaaagagcctggatcctcagttttcccatctctgcaagcagggataacggtaatgagaatgataataatcattatatgcagaccttcctctttcatcttacagaggcttagtgaggcttaaatgagattatatctgtaaaatcccttggtaaaggaaaagctccgtgaaaatgtcagttacttttactaagtggcgggtagtgaattatctgtgcctagtcccaaactgaaagtgtctcaggcaggaagttccaagggatgtatgtttatagcatccaggcaatgatctttttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctcttctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatccagagtccaggagtctgaagtggggccccaggtgatgtcattgctgctggtcccaggaccacattttaacaatcaatgttttcagatgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacc

SEQ ID NO: 742 - DNA, 1976 bp, Homo sapiens
agtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgc

SEQ ID NO: 743 - DNA, 2110 bp, Homo sapiens
tcgccttgaagttacgcttgaaggaggaaaactcatcaattttcggggaatcccgcctttgtttcccaggctctctgagcacgatgtctgcagctcccgccagcaatggagtgtttgttgtcatcccgccaaacaacgccagtggcctctgcccacctccggccattctgcccacatccatgtgccaacctccagggattatgcagtttgaggagccaccgctgggggcacagacaccaagggccacacagccacctgacttgcggcccgtggagacattcctgacaggagagcccaaagttttgggggctttggcagcgtgctgctcatggttcgccgcggccacgtgggcatcttcttcatcgagggcggcatccccttctggggaggagcctgcttcatcatctccggatccctctcagtggcagccgagaagaaccacaccagttgcctgctcattccccagcacttcaggggacctgcaaagtgccaggggaggggcaccacccaggcagaccagacgcagactgtgcatgtccaggagaagaagacagggatactctttcaatacacaagccagggtggaaagtgaggtccatgctcatggtcattccgagaaaggaaagatgctagaagatctcctgtaagagtcctgctgggccttggtgagcagagaggacttagaaataccacagggaaagctggagaatgcacggaggagtgtgggcagggtcgccactgaaaccacgcctggctccatccaacgaaggcaaaggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcacccacaccacagaaggaaataaaccatgtggcttaaattttg

SEQ ID NO: 744 - DNA, 2832 bp, Homo sapiens
ccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcaggcaagtgttaggtgagccagaagcaggacgtggtttatccctgtaaatgtcaatgaacgtaaccagtcttgtgcgcacacacacccagcagcaagaggccagggtctccgagacaaagaacatagactgaatgatagttgtcttcttcattctgtcctagagcaacttctgcacctgaaaagcagcaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttcc

SEQ ID NO: 745 - DNA, 1989 bp, Homo sapiens
ttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagtagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttt

SEQ ID NO: 746 - DNA, 2155 bp, Homo sapiens
aaatagtgggccaggcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggag

SEQ ID NO: 747 - DNA, 2054 bp, Homo sapiens
atgtttctaccacactataacaggagaaaaatacctttttaaaaatttgatcaggtatccatcgtatcagaataatgacatctgcccaattaaccaaatagaccctgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaactccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactcttt

SEQ ID NO: 748 - DNA, 2335 bp, Homo sapiens
ctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacgatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgat

SEQ ID NO: 749 - DNA, 2503 bp, Homo sapiens
aataaatatggagggcagtgtaaagctcagggcccttgtccactagagacaaggtgccctccgaccccttcttccaaatatactcttttgcctcttgtcttttattcccgtgtttgccccctttgttcagtccccctaggtccatgcaggttacatagtggtgccccaaacagtgacagaattgggttctcagcaagtggtgactcagaacagggacgccaaggatgccaacaagtggcgtctgaacacgggacttcgacgatgtgaacaaaaaagatctgctggagcagagaagctgaaattgacaaggcaaacggggaccccaggatgagtctgccggcagcatatataaggcagggactacaggaaatgaaggtgaactcgtggagattttggagagaatttaatgaagaggctgtttaccaaggatctctctctgtctccgaggctggagtgcaatgttgcaatcagggctcactgcagcctcgacctcctgggctcaactgatcttcctaccacagcctcatgagtaactgggactacagatagtatctcatgatatgaatggtcctggatttacttacacatcctccttttgatgagcaaaaagtaaatttttcacagtgatagacatttgtagtgctttttaaaggcactggttctcttggacactgagagacaatttttatttgctgcacgtggaaaggacaacaacatacctggacagaaatgcctcgaggatgtactgaaggcccctctcacttttcacagccataactgtaagtttcctggggcctctccagaagacaagcagatgccgctatgcttcctgaacagcccacagaactatgaaaaagttaaggctagacgggtcaagccacttgactgataccacaggtcagagcatacaaaggactcaagatcagactagtaatcaaggaagcgtgttgagccaagtgtacaaattcaacagctgggaaggtattatggggaggtcttgtaacattttattcaggtttccttgaaaagaactgaaaactgatgaaacttttagaccgaatattcctttgaaaacatgaatagaattcatttgctgagaggcatgtattgaaacgtgatatctagtgcatggttatttttcactttctaaattaaactgacatagagagtttgagaaataagtttaagaaatagacatggcttatgattgaaagcacaattttccatctaaatgttggtccgtgttcatctttatctcagttagtagcaacctttgttccgcagcagttgttcgttgattgttatggtctgtcgacagctccagctcgtgccatcttcccaatgtaccaacttctctttctctggtcaggttgtgctgttgcctttgtatgtcttcccacctcatggatgttagtttcattatgagaatattgagaaacagtcttccagtcataaccccactggcttccttttctctgtcacttccaaaccgcaggaccattgctgggcaccatgtctacccacccatgagagttaggaataaacacaaacgagttcaattcagttcagcaaacagttattgtgcatctattttatgccaggaactgcagaaggtgctggggtacaaagtgaagaagataatttgcttggtctcaagggggagctcctggtctaatacccaggctcctataatccctcagcattatcctctccactttgcctgttcccctgttgctcattacctgtgcaaccgctcctccctctctggctcaattcctgcttttcttccctctgttcctttatcctgctagtgtcttccttttcaaccatagccaacactccatcttcaaatgcttagcgatacaacttatacctcaactatctggaaaggctttctgaactaagtaggagaagttgtaaatatttaactttttatttttctaaattatctgattataagcaacagtaaaacaaagatcccatattattatctgcagagttaatttggggacaacagggacctcttagtttttttgattaattttaaacttacttgtaattaattggtagtatatgttacaaaccattaaaaattacttaacagtaatcacttttgaaaataggaggaaaataaacatttttatggcagatttgtttgccttaagaattattttgaaagaagtattagaatcgaggcttagaaaaacggtagagtgcttggctgggcgcagtggctcacacctgtaatcccagcactttgggaggccgaggtggatggatcacgaggtcaggagttcgagaccagcctgcccaatatggtgaaaccctgtctctactaaaagtacaaaaattagccgggcgtggtggcgcacgcctgtagtcccagctactcaggaggctgaggaagatcacttgaacccgggaggcagaggttgcagtgagccaagattgtgccactgcactgcaggctgggtgacagagtgagactccatctcaaaaaaac

SEQ ID NO: 750 - DNA, 2299 bp, Homo sapiens
ctatatacagtctctcaaagcaccttagacactcacgctttccacagagtccttctggctcctgcctgtggccagttctgaggccacgcccacatctatagagctgtttgatgtcagcactccttttccaggtaccagaatctgcattagttacctattgccatgatgtaaattattccagaactcagtgactttaagcagcaatcacttgtcatctcaagggccatgtgggtcaggaatcgagtggctcggctgggcagtcctggtatgaggctcctggtgtccagttcctcttagtctaagaactagaaacagagaggttatctgctcccttccacagacccagtgtatgagtttgaggtcatatgaggtctcagggaagacgccatacaggctgcagtgtctgaggtctggagccagaaaacccacttccagcacggttcactcacacggcaaggaggccggggaccaccagggccttggctgctctccacgcatgcctctccaaagggttgctggggtggcttactggtagctggcttactctgcagtaacccaggcagaagagtgaggtgagaactgctgtgccctttatgatctagcctcagaaatcacacgctgtcacttcctcagcactttagtggacatgggtccgccagttcatggagcaggggtctgaacaggggaacataggaggaggcccagatcgcggctgctgtgggtgagttgcacagcctctctcaagctgcaaaataagaacagcagcgccttcctcaaggcgtggttatgaggactaaaagaaataatggatgcagataactagatctagataactagatgcagtggctgccagaggtgaacactggcggcttggattgacactgtctttggtggtaccccctcaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 751 - DNA, 2626 bp, Homo sapiens
gcaccaggcttccactgactctccagcctgggacctgaggtttccatgtgcctgtcccctctgagccaggatccctcactttgtcctgggaaaatcactcccaaagtgctccagtacccttgtcccctgtttgatctcttccctagcttcacttccactcttcttcccccatccctgaaagattcttgtttttcttgcttctcttagttcatatctgcaatatctatggtgagggagatacacacactgccctggatctcaggtactggcttccctttctggtcagactcatcagaaacttctcaagggaagctctttgggagcaaacctcttgagttggaagttctgtttaggggaaaaagtatactggtgggtctgtgtgcattcctgggagggaagcaccatcttgtcagccagaggactgggtaaaatagatggttgcaggatgatttctgggttctcactgagcatctgcattatggtcatgttagccagacttcttttttcccctggggatgtgccttacaaccgttgtcagattttatgtagattaacaaaagctgaaggaagtccacttaacccagctccttcttgcttttaggccagatgagcgtcgctttgctgtcttctccattgctgtctcctcagatggacgagaagtactaggagggtaagtgcttgtggggtatgtttccctcaataacaagatgggggttctgccagagatgagttctgctgttacacagatggcactggcagctgcagagaacaaccagaccttctcccaaggtcaggatttacaagttgcttcaccccttgctctccatttccccagcacgagattggaggtgtcaagcctccttgaaacacagctaactcttcccccacttcctgtataaaaagagcaaagggcttgacccagagcaggatttctcagtggaactctctagagcatataccacgttggtcctctcgatcatggctccaggaccctcctttatcccttccctttcagggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatgtccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagcgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcggtgaggttgcaagggttgagggtgctggcacatgtctggggcttggacttgggtgggggcagcacatcctgactgcttgccaccctctgccctgcagtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaaggttctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctgg

SEQ ID NO: 752 - DNA, 2091 bp, Homo sapiens
aggctggtctcgaactcctgacctcaagtgatctgcccgcctcggcctcccaaagtgctgggattacagcactttgtcactgacaaagtgccactgcgcccagccactgatgactcttctgaacactgaataaaggaatgctttctaacagtgtgtccagtgccactaaaatgcacatattggaccaatattcttatcactgttttcccagtaagtgccagtgcccgccttcccgagtgtgtctgcgccgaggaagcatgcagcaggttgcagtgacactcacccaggattgttccgtgcggagtggtcctggcggtggagctctcggccactccccagttaatgctgctgtcagcactgggaacttggagaccctgttactagaccacagggatatggtgccccaggcagcggctcctgctgccatggtctcgagtgacccattattggaatcctgcttctgctcagggagggcactgtcagtcgcttcgttttacctgcatgcaccacatgtgtctgtggtttgtttttgttcaggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatggtaagtgtcgctcagccaggggatctaaaggctttcccagtttcctagatcctggagtccagatctaggggcttcagctgtgtgcagaccccatgccacttcagggaagtgacacaggcctgtgtcatctcgctttggcagcaggtgggtggccttcctcaggggaggaggtggcctgagatgtgtttcaggtctttgacccatcactccctacacacacgacgtgaacaccactcctggagcattctcagaatggagatttgaattccatgtggcagcttctcacacacaaacctgccatcattccccacacacccactcacgacattcaacagccatgagccaaaagaagttccttgtttcagatttgaaggttttatgaatccacttcttccggatgtagctctttaatgattttataaagaagaaagacttctgactctcccgtgtttattcaccagatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgg

SEQ ID NO: 753 - DNA, 2578 bp, Homo sapiens
ccagcttcccacccctggtaaccactgttgtactctcagcttctatgtattcaactttcttagagtccacatataagtgagatcatattatgttcttctttttgtaaaaaggtatgtttttttcttaattttttttttttttaattgtagagatggtgtctctctgtgttgcccagagaggtctcaaattcctgggctcaagggattcccctgccttggactcccaaagtgccaggattacaggtgtgggcaccatgccgggccaaaaggcactgtgcttgagatatttaaacctactcagggatggccgagaagaataagttcctggacctcagaaatctcatctggggcactggtggcccttaggcttagcttgaggggaggctggtatggtcccttcttaaaagagagtgactgtggtgaaatgagttagacagatcggtgttacccagggcaaatcattctaccaccctgaggcgtatctataagatggagttaaggagtcactggtgtgaagattaaactatgaatgacacctggcatatggttgacattgaggaaacccacgtttctttttattttctatttccctgagaaagaactaacaaactgttggtgcctgtagtgcaagccatggttatattttgccctaggataatgtcactggtcaccatctttatgtcttctacatttgctatcaattcaactgttgttatttccccaagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactg

SEQ ID NO: 754 - DNA, 2089 bp, Homo sapiens
attatgagaaaaggaagagagaccagagctcactctccagtgtgtgaggatgcagcaaaaaggcgactgtctgtctgcaagccaggaagagggccctcatcaggaaccaaatctcctggcaccttaatcttggacttcccagccttcagaactgtgagttgggaatcagactcttgagttgacagctggcctatggtttctgcattttgttaagaagcacctcatgcaagcgagggacctgggactgctcacagccaggagctggtattttcccctgccagttgatgatggagactgcggacacctccctttcagttggatgcggtgccctcagaaactcccagaaggcaagactccagccaggggttctcctgaaatgtctgaagggaattgctgggggtggggcgtggagagggaagaatgtgcacttgatcgcttaaggcttctccgtatcctgtacgtgaatctttgcccttctctacgcggatgcaagagtcctcttgctttggccacgtgctgctcctttccttcaggactgtggctaatcagaagttggctgcacttcagtgcctcttaaaagcttttttccctggctgtgttcaggatgttgaagtgcagtgtcagaaatgatgtgagttgatgaagaagaaataaacaaacccaggcagcatgtgaggaaggcttggcagccctgctcctgtttttctttagtttggatctgaaggaaccagatttcctcattggaaggaatggggctatgagggtccctgtgccatggagcctgagatgtgcatgccagtgggccttctggactagggcaccggttagtttaataactctgggatgaaaatgtgtagtttatggttggcagaatggagagaagtcacctggccgcaacccgacctatatgtctatatgtaagtggagttaaaatagcatctgttcagggaggcggaacattccagaatgcttcagtcccctcttggcgccaatgcagagagtggagaataggaaagctgggagagacttcacagagcttcttgtctaagccccttaatttcagtttaggacactgaataacttggctaaagccccgtgaggccaggggctcttgtctgtcttgtttgttcaccttcatacctttggtgcctgcattgtattaggtacttaaacatgcatttgtttggtgaatgaatgacataaatgaagatacgacttccgactcctaatccagtgctctctctgagatatttgtaggcagaaaagtctgtagaagtgttgccaaataacttgtatgtagttgaggctatcttgagattatatataggttagaacatgtagatgtagcaaaatcaaactggctccttaaagttggtggtgaagacaggcttgttcaggtttgggggtgggtaggaggcaggactgccactttgctcagcagatggggctcctttcacattggattgtgtgtgagtggtgccctctgaagttggacgatggccccaatagctcagcttccccagaagaatcaaggtgactgtggaaaaaataggcttgaagttgcccctttccttaccagcagctaggagcctaccctcgttttgcagcccagtccccgccttttcagagggatgtgtgacttggagctcatcagacttaccctctgtttgtagaggggtgtgtgtgtgtgtgtgtgtgtacgtatagaatgctgcaggtgtgactggaaggtcacgtttggtcactgtagcaacaggagtaggatgaagtcctgcacacagggtctctgccactgtccaactccatttggagaattgcaactctgttgccatgggccccaaccaaggaaaccaggtcttacagtgggctgcacttagaaaaccagggtagtcctggccagcatggtgaaaccccatctctactaaaaatacaataattagctgggcgtggtggcaggcacctgtaatcccagctacttgggaggctgaggcaggagaatcgcttgaacccaggagacgaggttgcagtgagccgagattgcgccactgtactccagcctgggtgacgagcgaaactccatctcaaaaag

SEQ ID NO: 755 - DNA, 2511 bp, Homo sapiens
tgctcttgggagcctttgaaaaaccacctctgacttgacctgggtttcctgttccccatgagtgctccagggctgcgcctaagcctgtgtcatggaactcaggggtgagccttggggttggcaccgggaccaggccatgacctctcttagtcatggagaattttccttggaaaattccttatctggcaacccagagggccccgcaccacacggagtcatatatgaagcactgatcacactgtgccctcaaggcctgagtccctcatgtgatttaaggaaagtctctgttactccccagtctgcttccctgttctcagacaactaaagggatccagaggcactgcaacattcattcattcattcattcattcagcagttatttgccacgttcctgccttggccggaccctgtgccagatgctgggggcacagtggtgaactgccattgttgtggaggcttcagttcataaaagattgaactgtaaagtatataaagattgtaaagtatacaattctcattgaattgtatactttaaatgagtcagttacatggcatgtgaattacatctctataaaactggttttgaaagatgatgaatgtgtcgagagctgtgaaaggggaagccctagtggagtgggagcccgtgggctgctataggtaggggagttagagagactgctctgagcatgcgatgtcgaaagctgaagcatacgtggaaggtgccccggcgcaaggagtgaggggacagcactgtaggcagaagaaagagcatgggcttcggggcacacagatctggtgtgagtctcagccctgccctttgttcgctgtgtccttatcaggaatgatggccctcaatttagcccctgctgtgtgcaagcactatgctagatgtttacatgtctcaactcaaaatccccacaactccgtgaggtagactgaatgatgaccccaggtttacagacgtggaaagatactgaggcattaaataacctgccagtgatcctaggtctgtccgacccaagcctgtgtgtttaaccaccatattctacctcccaaaggactgtttcttctctatgtcgggtaatcacacctctgcgaggtgctctgaaacagcatctaaagagctccaggtttctctttcttccttattttctgagcttcaaggcctttatggattgaaagctggaagctaagaacggggctggatctgacactggtcctagtgttggggaagggcactgttgagtgatgggtcccatctcagctcttccttccctcccttccctctgccccattccctctgcctgctctgcccacctatctctagtaggacttccctgaccttctccctttatttccctgctttttaggggaaaatttgtcaattattttttgatccccaaagaactctacattttggagctttacatgtttatttagtacaacatattttaactgtggtgatagaaattcagactgtaggaagaatcactcagaatataaagttccttttagtaggaccctctcctctactcggcccttctccccacttcccttccatgctgggccggcagatgccatgcttctggggtctggtcattgaggcagataaccccctacttcagataacttggctgcattttttgtgtggctgacgcagccccaccggctgtctgcaaactccctgaaacaggatgacaggcgggtgtttcttgggcacgtgctgcggcgcagtcagctccacttgatgattggtttggatgaacgggagagaggggtggaaggggtgttgagaggggagaagaggccaggaggactttagattgtagttacatatgcacaatctgcccgttgttttagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaacc

SEQ ID NO: 756 - DNA, 2678 bp, Homo sapiens
acctcagcctcctgagtagctgggaccacaggtgcgtgccaccatgcccagttaatttctgtatttttgtagagataagcgtttcaccatgttgcccaggctggtctcaaactcctgagctgaagcaatcctcccaccttggcctcccaaagtgttgggataacaggcatgagccaccatgcctggccctattatttttctaatcagaataaaaatgatgtttttatgagcagaatacccttactcattgtctctctcagcctcttccacccccatcacattccttgtaacacagggtaggtgtcacaggctttgcctctcatgactcagggtttagggacactgcatcacccaccccttcaagcaccagccccagggcaggaggtgggccctgaggaagccaatcatcgtttagagcatcccagtgtccttagtaccacaggtcaggtcctcagctgctgcagccttacaactaacctctaccccaggctggctggcacagggctgtcgcttgtcctgtcttgtccttcctgccttagaacctgaactgagcccagctgactgtgggaaagtttccatttgggccagctgcagtgtcccttttccaggccaggggagtaggaggtgggctgcctgtctcattctgtgagctgtggaggagcccacagagcacagggccaagtaaaccctacctccaaggagctcacagtttggagagactgacagtgggggcagagcttgcagccaaggccccggttgccaaactcaggaacttggactttactcacatgaagccagacacactctccagtctaagagtgacaagggttggatttgagttttagaataatcactctggctgttgcgaaaaggatgggcccagagggagggaaggcaggaggctggcagagtgcaaagaagagctgctgtgtgcatggctgaagactgagaggaacaagggcaaacattgcccaccccttcccagagacccacagtgcaaatggtgactgcccaacaccagcactgtggccctggggatgagagtctgaggtaaggtgtggagattcattgcagccctcaggcccatggaggtccaggggaaatgacacatccaatccctccctaccctccgggtatgccccggtatccctctcccagccagtttcctctgacccaaggtcatccttgcagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtaagaatccaccccctgtgctcctgctgggcactgttgtcaaggcctgagcctctccatcgggcagggtgacacagggagccaacacaccattccttggtgctgggcctgcattgggagatgcaacctgcttcagacatggtgggtcagggctgaggaggagagctgtccatatggtcttgagaattcaactcggataacatcttccctaggaggccttctttgacccccttttctggggacccccagcccttgtgttgccttttgtacaacctgattgttgtccatggcactgtaatcgtccacctgcctgagacctcccaccagactgatgcattgggatccccaacacctcgcaccgacttggcagaattagggccctgggaatgtttgccaaatgcatgagttcccaaaacaaccttgtatcattagctgcattttacagatgaggaaactgaggctcagaaaaatgaatagcttacacagaaccagacaactccaaaggggctgggctaggtctggggcccaggtccagggttctttatgttttatacctgactgtgtgccggggatggggagtggatccatgggcaaccctgactgttgcgtccttccctcccctcaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaacc

SEQ ID NO: 757 - DNA, 2439 bp, Homo sapiens
tttttttgtgaggcaggctccaggggatgctgagctctccttgtacgactcagaggaggacattcgcagctactgggacttagagcaggagatgttcgggagcatgtttcacgcagagaccctgaccgccctgtgagggctcagccagtcctcatgctgcctacagagtgcctggcacttgggacttccataaaggatgagcctggggtcacagggggtgtcgggcggaggaaagtgcatcccccagagcttgggttcctctctcctctccccctctctcctcccttccttccctccccgcatctccagagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcgctgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtg

SEQ ID NO: 758 - DNA, 3017 bp, Homo sapiens
acgctgctgagcccgaggacaggcggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgaccaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctgcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaatggacaaaactctggcaccatcctcagaacaggaacagcctgaggggctctggccacccctagcctcacctctacatcccctggaagtacaaggactcatctgtggtccctgcctctcctccctccctgaacaccttggctctgttcccaagcagctggacttccagagacatggctcagatcctggatttgcagggagttggggccactgaactccaagataaagacaccatgaggggactgaaggtgggcaaggggatttcctttagctgggcatggtggcgggcgcctgtaatcccagctactcaggaggctgaagcaagagaatcacttgaaccctaaaggcagaggttgcagtgagccgagatagtgccactgcactacagcccgggcgacagagtgagactccatctcaaaaataaaataaaatt

SEQ ID NO: 759 - DNA, 1994 bp, Homo sapiens
tctaggcgctgcgtgggttccactcaccgcctggccgtttcggggccgcagtgcctccctggccggcagggggaggcacacgctcgccttgtcctggcgcttttcccagtggcccggctctgccgacgaggctcttttctccctagggggaaattttaaaatctcacccccccagtgctggggggaaagcggaggatcctcgcgtgccgggagcgggctgcgaatggggcagggcgagcgcacgtggggcgtgtttacaaacagcagccgcgccgccttgcggaggcggtccaggtgtcggagcccagagtcagcgcgcgtggaaagtgctagcccgagcgaggatcatgaggcacgcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggaaaggggaaagatcctgatgtgacatcttgacagttgatcctttaataaacctaatggaagttaacaaaggaagattatttgggggccgtgacgaggagttcattttaaatggatgagtaaaatgaagatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagatcccaaaatccaggagtgagggatctattcaggcccacagagtaccgcaaccagagctatctgatggcattcctcagctcagcttgcggctaagttatagaaaagcctgcttggaagacatgaattcagcagagggtgctattagtgccaagttggtacccagttcacaggaagatgaaagacctctgtcacctttctatttgagtgctcatgtaccccaagtcagcaatgtgtttgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaagg

SEQ ID NO: 760 - DNA, 2093 bp, Homo sapiens
cccagtcttgctgtctttcaatggggcagccactgctcagttgctgccattcagaaatatgaacccagtatcaccagaacttttgatttttcaagagaaaccaagattccagatttgtaggtgatatcttccatttttcagataaaacaaaggaaccagaaccacatccactgatcggatttgcctggggaggaggggtgctctctcctttgatcttctcttctggaagagatggaccaaaagcctctccagcaataatccgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaagtgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctggctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcatt

SEQ ID NO: 761 - DNA, 1785 bp, Homo sapiens
atgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagattt

SEQ ID NO: 762 - DNA, 3159 bp, Homo sapiens
agatggagtttcttttcaggaagaacactctgacagctgcatggaagcccagacaccaggaaaccctcagattggaggctggtgtcccggagcagtgcaaggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacac

SEQ ID NO: 763 - DNA, 2139 bp, Homo sapiens
aagtgacacctcctctaggaagccttctttgatcaccccaacctctcccagacctctaatgtggaccccacagtccctggacttctttgagaccacactagcccactccccgccccctcctggaaccttgagcttctggagagctggggccacaccgtcctcctgtggttttccgagccggtgcaggtggtcagcagataaccttgagtgaatgtgaatctaaaaaaagtaataaagggatctggcacacttaacttttaaatctaaatatgtttcttttaaattctatgattgttctgggtcttgagagcagacctccccaacaattcggtctcccatatggggtcacagccgtttgggtttccgatcgcgggcacggcacccatctgcggtgtctgtgaagccggcgcgttctgccgggggtttgggtttttttgtgtgtgtgatagatctttttagcttagatacgtttcttaaagcttctctttgtttaaaaatgcgcaggaaaacttcggcgtcgttctatttttgtcctttctaacacctacccctgatttttccttctttttttatttccttgcagactttgaattttaaacagataaaaatggatgctgtttccatcgtttggtgtcctgcttttctacgtagaggaaacatttctcagcacaattaaaacgtgttcgtatgcttattaatgtctttgtaggatttcatcctgtgaatcatttgcttgtccagcaataaggaaatggctttttgcgtctgcgttttgatgatggaattccccatgggcttcagagtgcggtgcctgcctttcagatgatttccttaggaccgagttcctgggacttgctgcttcatggccagcgtctcgggcccctgtcagctctggcctgtcctccctggggtgatggccctgccgggagccgtctgtccttggcagatggagttcactgttagtgagagcccagcctctgttttacaaacgagcatgctccaagcagtggctgatgggcggttggaattcaccatggctctggcctctggttcctgtaaattgaggcgtaggaaaattagtcctccccgggtcctctggtttacagaatgcggggatgtccaggtttctcctgtcctcctcatccctgcactggttccacgggactggctggacacagcgtcactggttcccagcacagctgacaccccttccaggaaccttctcactatccccagggcagaggtggccttccgggcatgcgtgctcctctcccgtctcctctgcagcttccttttagtccagtggtgtttcaggtgtcttgctcttactggagctccttaaggacagggcctggatctcagtcatccccaatccccagctaaccccagctcatgttcctgattggccctgggacactagcagaacgtgacttggttctgttcactagtgccatatagagtcaggttcctggagctggtgtgagagtgggaggtttgaatcttcatgggcaggggctacattgtgtcaggctctgagcttggcattttccatgtgaaaggagacaagggctccaggagaaatggcctgtatttgctggggtgtaggggcgggccacatgccactgagctttagaagcctgctgggttaggaatcagcacacagcctggatcagtgaaaatacaggaacaagaagataataggagagtttgtgctgtaaggcaggtgtttacagtttgatttttcttcagtgagtagaaatgttggcgtagcttgaaaaaaaatctgaaataattcactgtccacggaaagggctggaaaggagttatcttaaattcatatagattaaagaaagcatagctggtcgtggtggctcgcgcctgtaatcccagcactttgggaggctgaggtgggcggatcgcctggggtttggagttcgagaccggcctgaccaacatggagaaaccccgtctctgctgggaatgcaaaattagccgagcgtggtggcaacgcgcctgtagtcccagctactcaggaggctgaggcaggagagtcgcttgagcccgggaggcggaggttgcggtgagccgagatcgcgccattgcgctccagcctgggcaactagagcaaaactgcgtctc

SEQ ID NO: 764 - DNA, 2262 bp, Homo sapiens
gttgtgaccagagcggtggcgggctgagcggtttcgagccggcgtcggggagcggcggtaccgggcggctgcggggctggctcgacccagctggagatctcggcgtccgcgtcctgcggtgccctggggtctcccgaggaccttgtacccgcgcggtttccttgggctggctttggacgacgctttcgccttcctgctgcctaggacccgccgacatgaatcccatcgtagtggtccacggcggcggagccggtcccatctccaaggatcggaaggagcgagtgcaccagggcatggtcagggccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcaatgagagaaatgcccgtattaggaggattacttgagccctggaggtcaaagctgaggtgagccatgattactccactgcactccagcctgggcaacagagccaggccctgtatcaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgtacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttccttggtggacagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaag

SEQ ID NO: 765 - DNA, 2322 bp, Homo sapiens
agatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcgatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcactgctatatgtagatatatttcaatttaagcaaaacaagctgcaagttattccctggcatgctcaaaggattttcgtgcttttcacttaatagtccaaagtctcttaaattcctgctgcagatatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcct

SEQ ID NO: 766 - DNA, 1773 bp, Homo sapiens
cttgttagcccacagcctgtaatagaatggacagatgccaccctagttgtgtcttaagaaattaagaagcttttaggtgtttaataaatgagagttgagcctccctttctgggactcacctgaaccacagtctctgagggggtcttgctgcattcacagataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagtcttgctctgtcacccaagctgaagtgcagtggtgtgatcttggcttactgcaacctccatctcccgggttcaagcaattctcctgcctcagcctcccgagtatctgggattacaggcacccgccaccacactcagctaatttttttgtatttttggtggagacggggtttcaccatgtcggccaggctagctttgaactcctaacctcaagtgatccgcccacctcggcctcccaaagtgcccctcatgcttcttataactgtagaagagctactgcttgcctgtaagtgggtggtatgggaaataccacactgggaaatctgaaattattgggggaccagatgtctggagacctggattctctccagctctgttatccacaggtatgtgaccttctgagtacgtcagtttgtccttctgacacgctgtttcttcaccaaccacgaataatattatctgttctacgtagcttatatgaatatatgtgaaagtagtttgtaagctgtaaagcaccagttcatgtaagaacttattatagcatttccatgatattcatcatctggaaatatgttgttcactgtaaattgaagcaaggataaagaggcatcatattcaaatcagctgtttcaaaattagtatttatgctagaaaaagaaatgttttaatttaaaagatgcttaaatgttccgtattttaaattattggacggctacttctggataagaaaaatttgttttggtttctcacgactggctgttgttcatcatgtgacttgtttaggcacacgattacaacactctgtctagaggtttgctgccagaaacctatagctgactcttcctgggaatcaatttttgatttccctgttattgatctgataacactctccccaaaatataaagtaaaacaaaatgtattctgaagcataatatgtgtttagtttagtattgttttaattttagatgctatttactttgttgttatttgaagatatgcaagccttctaattgaaatcagcaattgatataattgaataaaaatgttaccaaat

SEQ ID NO: 767 - DNA, 3036 bp, Homo sapiens
tagtcggctccctcactgcctctggacttgccaaagttttgttgaggtggagaggtcgccacaggctgaaagcattaaggagaaccaccctggcatgcggagcagtcggtgtgctttggaggaaaacatacaaaccagctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccgccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatggcaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 768 - DNA, 2510 bp, Homo sapiens
actgagacatgctgagcaaaggccggagccccagaagaaaacaagtacagactcagaggaaagctgccctggtcctgagtgtgactcccatggtccccgtggggtctgtgtggttggcaatgagctctgtgctgtcagctttcatgagggagctccctggctggttcctgttctttggggtcttcctccccgtgactttgctgctgctcctcctcatcgcctacttcaggatcaaactgattgaggttaatgaagaactgtcccagaactgtgatcgccaacataatcccaaggatggctcttccctgtaccagagaatgaaatggacgtgaagttggggactttccaataactaaagcacaatgagtttctactggtcagcaagcaatggccaacagttcagctaataaagtaggttgataaactagaaccatagcaaaatagaaagaatactaagatactcattctgaaccatactgaaaagtggcagctattatctaaggggacttctcagagactcagtataacagcagctcttgaaaagtaccaagaatggatttcctgggtatatacactggacacattgtaactttttaacttttattgtgactgtgtctgctctaaacggcatatttaaaaaataaaattctgcagcatcttactacataatcccataggaacccctattattccgattttagaggtgaagaaaccttggtagagatccaatgaatagcaaaagatgaatgccttggagagagctcagtagattccatatgcaagaatatttccacgttcttcttgcagttcagcaactcttaagtgacacagttcaggtatcatttttggacctgactttgcttctctccttttcctgattgctttcacaaatcattattgtcacaaatatgcacaaaacaagtggagtatccccacactaggtatggatcacccacaaatgtagctttcagcatgatgcgacctggaaatgttggcaatttggtaatgggaaaaggaaagggcagaatgttcacataattcctgaggaggagaatacaagtctttgcctgtaataccaaaatacagggagctatatctaactatgcggataagtcaacatttcactacagttctttttcagtgggagccccaaagagacaacataggtaattgaaaagaaacttaattctaggggtagttaaacgagattgtggttactgttgtgctccccacattcttccagttaacataaatcaaagatgttcaatgcattctaagtgtaagactggttacattccaatctttgtgcaggacattaacaggctgagtgatccactttatagaacataatgaatggggtcacctgtaagaaatgcacctgtttcagtagtggcttacagtcatactaaaggttgtgtggatgacccaaagcaaaaatataccatcagtgctggatttttactgcttcttcccctcagccccaccctaaaattcttgatacccattccgtgagtagtttccatttgcacttcttgcataatataaaacttattgctagaataaagacactcacttctgcattttactgcacttgattacaatgaaaatgtctgccggggttttcagactgaactaattcagagtaacagtgctcttgccatatggaaggaataacaatattctttcagttttgggagagatctctttttagcccctgggggaaatcagcttatgtaaaaatgctttctttaacagaaagtgtgaaaggacagatcgtattcctatctcaggcagctgccagccacatttgtggctcagctatcaaggtttgctccatcttcctccaataatgggcacttcagaaggccagttccagctctggtgggtgctggtccaccatctcagctattgtgataacacatgagctctatatagacatgttttcagcaccaagcactaccaagtactttagaacaaggcctgtttcttttctgccatccaatgagagcagagaatctccaatgaaactgactagatttatgaatgttttttatatgtagagaggggcagaaacatgttcattttcccatgaaggaacaagtcccaagggtttatcatctgcctgaaggcactgctaacgaatttgtcaaatcctttatccagcacagctttaccaagcagctgcacagtcaggcctttgcacttctcattctcataggtccagtttaagatctcattcagtcctgaactgcttcggtcctttgcattcctgctgtcttggcctccacctagaccaagtcggcagtctccctacattaccctacattcagctgcatcctatgctccaaggcctttcaccaggggccagaaatgctcccacaaccctcaatggtctcactacaacagttccgaatcttattccaaatgctatagtatctgaaacggttcaccaatagggataatgtttctccaactggagaccttcaataaaacacttcaataggtgcttt

SEQ ID NO: 769 - DNA, 2005 bp, Homo sapiens
gttatctccagaggggatattacagggctgcagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcgacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagtggagcccgcagccctccggccatccctggccttgctggcgcgcctctccagccttggcctcttgcattggcctgtgtgggttggggccaaaatctcccacgggagtttttcggtccccggccatgtggccggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctcc

SEQ ID NO: 770 - DNA, 2460 bp, Homo sapiens
actggcaaatgtgagggctccttgtatcgcagtccaaccccagctcatttcttagtataggtttgtttttaggatggtcgagctcaaagcagaactaagggatctgccgttttgtacacggccgaggcgcgcggctccctgggcctggaacgcgctctgagcgcgccggtcccttccaggttgcgcgggctccggacgagacccagcccagccgggcagccccgcgcgctcccgggtcccgccggcctcgcgccgcccggttgccgtgggaaccacggagcctcggagcgcccgcagactagcccgtgtctgagggggtgagggatactgaggcccaggcatggagctgccagatccggtgcgccagcggctgggaaacttcagccgggccgtgttcagtgataccaatcggaccagtccagagtccaatgagggtccggaaaatgaaatggtctccagtttggcactgcagatgtcactttattttaatacctactatttcccactgtggtgggtgagcagcattatgatgcttcacatgaagtattcaatcttgcctgactactacaaattcatcgtgatcactgttatcatcctaataaccttaattgaagccatccggttgtatctgggctacgtgggtaacctacaggagaaggtaagctcttttttcctttctctcagtgatagatataaatgaaatcagttttcataacaagtaaaaggcagtgaggtgtggcagaaagagcacaggcctgaatttaaagcctgactccagctttaccacttctgtcactgtggtctgtttgcttaatctcttgagccctggtttcctcatatataaaatgaggaaaataatatttacttcacaggtttgttgtgattaagtgaaatgatttatgtaaagtatatgaatgtagtaaacacttaaagttgatattttccctcttcttatcagtcttgaaaatacatggttacttaaacatgtgtatttggatcctgaataagaaaatgggggaaaattatgaattcatttcctatgccaggcccatgttttctgcatcatcatgctgcctaagcatttgtgtttaccagagtatagggataatgcctaaagattcccgtggttttctaggcccttcataataaggccccacccagcctgtcttactgtaggttttgctgttttctcactcagccatccattccaggctgatgtgctgattcccaatcatgctaatttcacgtgtttgcttacttacctttttgcctcttccttcttctccacaacttaaaaagcctacctccctgaggtctttctttcacctaccctaatcactcccttatttcttgtagcatttagtctgtacttctaaatattgcacttaattgttcactaaagtgtagtattctaggattgttttacatgaattagttttctcatctagactgtaagttctctgaggacaaggaccatgtcatcctcctttggaatcactcacagagcccataatgtaggttcacggtagtgataagtacttgtttatctgtataaacagaaactgtattttactgatttttattactcttgatatgtgtcattgcaggttcctgagttggctggcttttggcttttgagccttctattgcagttacctttaattcttttcttgctctttaatgaaggcctaacaaatctgcccttggaaaaagcgatacatatcatcttcactctcttccttgctttccaagttgttgcagcatttcttaccttaaggaaaatggttaatcagttggcagttcgtttccacctccaagactttgaccggctctctgcaaacagaggagacatgagaaggatgaggtcatgtatagaagagatctgatccagtgttgttgagtgaaaatctgacagatcattctagagactgtaagagttaggaaaatatcagagctctgagaaaagggacaaagcaagtgttttgaattgtatatgctctcactctgaaattccaaggttgggggcaatgatgaaactttgtacagtatatgaaacagtatattaaccctaaaacctagatgttgtccacctgatgccaaatttcttaattttttttgatgttgttgtctttttcaggagtgtagaaatctatgtattggtggttgtcatttgccagctctctcgtagcatttctggttagaatctttaactagagatgtatacatttctttaaaacttgttggttatccatgtcttgtctgtacatatgaccatgtttcttgacatggaaataccagtcagtgttcctatgtatttgtctatatttgtaaaccaagagaccggctgggtgtggtggctcacgcctgtaatcccagcactttgggaggccgaggtgggcagatcatgaggtcagaagatcgagaccatcctggctaacacggtgaaacccagcctctact

SEQ ID NO: 771 - DNA, 2121 bp, Homo sapiens
acacacacaaatacaggaggctgccggcgaaactctcccgcagccacaagagtcccggggcccgcgcgcagactgcgatccagctccggctcttgccctgcggaggctccgcgcgagaacctggctccacccgggaccggccaggtcctagccccgaagggactggacagccgagggacgcggactgacctccctgcggcgatgcagcccacagccgccggggaggaagctccgcggggtccatgggtgccggggtcacggcccggggcgcgcggagccacccagaccccgcgacccgctcttcggatagcagggaccgggtcgggaagaccttcgcggaccctgcagaggcgggagaccctgcgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctccagggcaggagagacgaagtcatccccgtcctccagctccaggtccccctgtccggggccgaagggaaagagctcctggcggctcaggcagcccacaggccccgccagcagcagcggcagcagcagcgcccgcgtccacgcagcccggatccggctgctcgaggccaacatgttcccgaactgcggtcccgcaaacccggtcccgcggccaggacagaggaaggcggggatgtaaccggacgcccctggcagccccctctcctcccgcctcccggcgttcccaccccgggaaataggggaggggagcggaggggagagcggagggccccgccccgtccagcgggcgcgccgcggggcagcccaatggccgcgagggggagggcgaggggcgaagccgaacctcccgccttgggcgccggtgcctgcgattctcgaaaccagcccgactcccagcgaacggcgcctccgggagggggagcagagcgcgggacccgcaccgtggtcctctgattagggttgggtcgtggagagccggcgacgtggaaacgctccggattcaggaacggcgcccaccccattgccgctcggccgcgtccggggtccaattcgcttgaccctggtaggaagacggggtgggagctgggaatcagccaagagacagagccaccaacacgttcatgggctcatccacccattcattgcgcgttttttgagtgcctgatcctgtgctccctattgtggaggttcgccaggaaacggggtctcaccctccgaggcaaagtcaccagtgtacaacacaagccagtgtcagatgggggccccaagtcatcaaagacattagggctggaaaaactggcggggaaagctgcaggtgggacggcgggaatcaacccgggtgctctggaaggaatgggatgtcatcaggcggcagagaagggaggtggaggaccgagctgggtttattcagggcaccatcccccagcagaggatgtggggagggaccggttgaagtacagccttgaatcacaaatttaggaatttgaattcgctctgtcactcggagaagaaactattgaaagttcttgacaaagggagataagcgatttaagtggtatcctgaataatcggttgatcgttactttggcactagggtgaaagtagagacaggtaagttattagaggaccaagtctaaaacattgaaatgaaagaaggagcaaatcctgattataagattggcattgaagaggagaagaaacgaagttaaaattgagttcaagggtttgcacttggaggactggaaaaccagtactgccttttgacgtcagggaagaggatctgggacagctggagttggatatgtttgatgtcagacctatcagcggtcaacaggacgtccccgtttcctgtcagcagctaaaagtaacgaccttgaacctagtttataataatttttcagaaaacagcaaattctgtataaaatttagggggcatgagttctgaaccagcaaagacaggaagaaaaagcaaaggaaacatgccttctaagcaaaacacttttgatttactcatg

SEQ ID NO: 772 - DNA, 2974 bp, Homo sapiens
atatgatgcatgaaatggggtatgtccctagtatgggactaggaaaaaatttacaaggtttgaaggaaccgcttcaagcagaaatacaagtttccgccaaggtttaggatattatttttgatggcggccattgttaagcctccagaacctatacctttaaaatggttaacagataagccaatttggatagaacaatggccgctaagtaaagagaaactgaaggctttagaggaattagttactgaataattagaaaacggacacatagctccaacattttccccttggaattctccagttttcgtaattaagaaaagaatcagataaacggagaatgttaactgacttaagagccattaattcagttatacaacccatgggtacattacagccaggattgccttctcctgctatgattccaaaaaattggcctttaatagtcatagatttaaaagactgtttctttactatccccttagctgagcaagactgtgaacagtttgcatttacaattcctgcagtaaacaacctgcagcctgctaagcgttttcactggaaagtattgccacaaggcatgttaaacagcccaacaatttgccagacttatgtagggcaagcaattgaacctactcgttaaaagttttcacagtgttacattattcattatatggatgatatactttgtgctgcccccactcgagaagtattactccaatgttatgatcacttacaaaattcgatttcttgcgctggtttaattatagctcctgacaaaattcagactactactccttactcctacttggggaccttagtaaatgacactaccattgtgccacagaaagcaaccatacataggaatcaattgaaaacattaaaggactttcaaaaattactaggggacattaattggatacgacctgctctaggcattcctacctatgccatgagtaatctattttctatccttagaggagatcctggtctcacaagccctcggtaattaacaagagaagctgaggcagagctgcggctaatcgaaaagcaagtccataaagctcaaataaatagattagatccagagaagactctagatttgctaatttttccaactcagcattcacctactggtgttattgttcaagagtgagatcttgtagagtggctttttcttccacatactaattcacggactctaactccttatttggatcaaattgctactatgataggaaatgggagaactcggattgttaaattacatggatatgatcctggaaaaattattacccctctcacaaaggcacaaatacagcaagcttttataaatagtcttacttggcaaaccaattaagctgactttgtgggtattctcgataaccattttcctaaacaaaactgttttaatttttgaaattaactaattggattctccctaaaataactaaatttaaaccaattgaaggtgctgaaaatgtttttacagatgggtctagtaatggtaaagcttcttattctggctcaaaaagtaaagtttttcagatgccctatacttcagctcaaaaagtggagcctgtagctgtaattgaggtagtgactgcttttcatatgcctattaatgtgatttctgactcttcatacgtgattcattccacacaattaactgaaaatgctcagttacaatttcctgcagatgaacaactgatgattttatttacccaactgcaaacagcagttaggagtagaatgcaccctttttacatcactcacattagggctcatacacctcttccaggcgtcaccttttgcagtgttttgcagtgatgggcattccagcttctattaaaacagataaagccccaggctacactagccgagctctagctacatttttctctatacggaatattaaacacattactggtatcccatataattctcaaggacaagccatagtggaaagaatgaatctctccctgaaacagcagttgcaaaagcaaaaaaaaggggggaaaacaaggactacgggacaccccatatgcaactgaatctagcattgttaactttaaattttttgagcctgcctaaaggccagatcctatcagtagctgaacagcatctacagaaaccagctgcaaagacagaagcagaacaactagtttggtggagagatccaataacaaaaagttaggaaataggtaaaataataacttggggtagaggttatgcttgtgtttctccaggactgactcaacagccgatttggataccatcaagacacctgaaaccttatcatgagccagatgctgaggaagagattccgggaggaaactgaggaccccccccacccccggttgcagccatgtcgagactggcgctgaggaagaccccaactgtcacgagcaacacctgtcaaacacagccacccacctggagacagatcaagaagctgtcacagatggtggaagaaaacctgaggaaagtgggacaaccagtcgcaatgatgtgcagatgcggatcctgactcctgtgagaagtagctcaccgtgacaaagctgcctttgcttttatcactttgcaaaacaaaaaaggggacatgttgggaacaggcccctgaatctggccataaactggccccaaaactggccataaacaaaatttctgcagcactgtgacatgttcatgatggccatgacccccaccctgaaggtcgtgggtttactggaatgagggcaaggaacacctggctcacccaggatggaaaacggcttaaaggggttcctgtaccacaaacaatagcatgagcgatctgtgccttaaggacatgttcctgctgcagataactagccagagcccatccgtttattttggcacatccctttatttcccataagaaatgcttttagttaatctataatctatagaaataatgcttatcactggcttgctgtcaataaatatgtgtgtaaatctc

SEQ ID NO: 773 - DNA, 1698 bp, Homo sapiens
gtgcttccgcaaagatggcagttttacagtctccgcacagaaaaatgttgaacatggaataatatatattgggaaaccgtctcttcgtaagcagcgcttcatgcagttttcttcactcgaacatgaaggagaatattatatgacaccacgagacttcctcttctcagtgatgtttgagcaaatggaacgtaaaacttcagtcaagaagctgacaaaaaaggacatcgaggatacactgtcagggatccaaacagctggctgtggatcaacttttttcagagaccttggcgataaagggctaatttcatataccgagtatcttttcttgcttacaatcctcactaaaccccattctggatttcatgttgcttttaaaatgctggatacagatggtaatgagatgattgaaaaaagggaattttttaagctgcagaagatcataagtaaacaagatgacttgatgacagtgaaaactaatgaaactggatatcaggaagcaatagtgaaagaacctgaaattaacacaactcttcagatgcgtttctttggaaaaagaggacaaagaaaacttcattataaagaatttcgaagatttatggaaaatttacaaacagagattcaagaaatggaattccttcagttttctaaaggtttgagtttcatgagaaaagaagactttgcagagtggctactttttttcactaacactgaaaataaagatatttattggaaaaatgtgagagagaagttgtcagcaggagagagcattagtttggatgaattcaagtcattttgccattttacaacccacttggaagactttgctattgccatgcagatgttcagtttagctcatcgtcctgtcagactagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaccacaacatcagagtatacaagaatactggaagtgtgtgaagaaagaaagcattaaaggagtaaaagaagtctggaaacaagctggaaaaggtcttttttaataaaagatataatagtatggcaattatattgttccaaatgtcaaaatttgtgattttttagaagtacttgctatttatcttcttaagtcttcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagcatcaattccagacatcttcatgttcctaataggctaaatgaagttaaaaacttatttcagatttttctcatctgtaccttatatctcataaatttattgcatattttatgtcagtagcttagctgtttattgtctttaaaataacatgtaaacttcaatgttctatctggaagcagaataaaatatttacatagatacaaaaaaaaaag

SEQ ID NO: 774 - DNA, 2002 bp, Homo sapiens
acttccggagccgggcgcggggccgagggctgggcccccctcttcccttccctcctccagcggctgcgctccctccggcgccctcggccccggggcggaggcggcccccgccgctgggaagcgagcgccgcggctctttctacgcgcgcgcgcgcgttgaccgcctcggggtcgcggcccttgtccgggggttgctggggtcctcaggcctatggctgccgaggcgggcgtcgtgggagctggggcctcccctgatggggattggagagaccaggcctgtgggcttctgctacacgtgcatttgtcttcccgactgggtcgcgcagcccctgtacgtacaggtcgtcatcttagaacagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaat

SEQ ID NO: 775 - DNA, 3436 bp, Homo sapiens
ccctcaaataagagccacaaacgtggaagatatatccaaaggaaccaaattaaaggactggagaaagtctaggtgagatggctttgtcccgttgcaggcgagttccaagcacagagaaccaaatggtttccacagagaacatgtgtagaagggattgtaacccacaactgtctgaacccaagcactaagcttcaaaccagactctgtgctgcttctgctttatacacaggccctggctgaaaacccttgactttaccaggcatgcaaggagatgctaagtccactttggctgcagatctctaaacgaccacggcccgaagtgtcagtttcaaatgcttgtttcagctctgccctccccacatcaaatcccacctctctcacgctaaagcatcataatatatttgtgctgagagttgccttagaaatcattcagtattcagttcacgggggaagaaacagaaagcccctagaggtgacctcattagcctacagttgccctgagaactggtggcagaagcagattggtgtccagcctcctgatgtacatgccagtgctctttcccccaagccatgtgtctcctggtcacgccctttgtccttgctgtcctctactattctcttctggaagactcacgatgagagagccgacttctccaagctgcactcctagctctctgggacccagcagggaccgctgccttccagccagcagtttgaagaaggacagctaccatcaaacacagacttacagcctccctgatgccctggatgccaggaaatgtctggaccagtcaagataagagcaaggcagagccaggaagaaatggggacaggagttcctatttaaatatataaagaatcctttcctaggtagagaaaagtcatctagcaatgtgactgatcacctctccgtttatctgtttgatcaactggaatttctatacagaaggtttatacaaagaagccacaaacaaccattgtcacaatgacccctacataattccttgtgtaaatgctctggaaatgcacccagaagtctggagaaggtccaatcaaactgggtggcaggaagaagcaagctctgttctcagatcttcaacagaatcacctggaccctggggttgccaccacgctaagccaaggaggcctctgaatgcacgggagtgcagggtctggagggagttgttaaaaggtgtttcttgatccaggaccatgtaaagacccaggagaaataggtatcccaaagagaacagcgtataagattcacaaaccaatgacaaacacgctgggttcgctgctggtctccacagttggttggttctgtagggctcagctgcctctttctctctacttctggtttcagaaaacacgagagagaagccgagtgctcatggagtttcctcaaagactcagcaaaaactaggctttgtgttctgagatcaggaagtaacagtgagagtccaaaattttcttccctgacaatgtctcctactcaaacagggcctggaagtcaccccctagaatcaaagccttgacatatgcaagctcatagtttattgcttcttctcccatctgcccgttgacagataaatcccagagggaataaaaacacattgccctcagcagattattcttcactgaagaataccagtcttttaacactccgctacagaaatagctttctgccggctgatggcttgttgcgctgcactaagagagcccgcacacctcgaagcttcgtcaagcaaagcctatgatttcacagacccagaaatgttttctttctctaagccaataacatatgcttgggtttatgccaactctaccagaggcgcacagatacaatgaggcatgaagttcagaataatagaaagtagagagttggaaagcacaggagaacccatctagaccaacctgttttgttgaaaaaggagctccctgacccagagaggttaagggtttgctgtgagacggtgcccctggttaaaggcagcatgagatgctgtcctctgatccccagcttcctagggctcttgcctctaggtcacactgccttgaggccaggagctgatattgattgaacagatgtgaaaacagaagaaaaaaaaattgtggtgactgccctctgacaattttccactttctttggaccaattttctttgccattatctggaaaaaaaaaaaatgtccagaagagcattttaaattcaggaagtggttctggaactaggagaagacacaccttgatgacagtaatattgtctaagtgagaaggaacaagctcttgaatgtttctagaaaaaccaaatatgataggagaccataaaattatacttcgtcatatggatttccagtttgagaaaacttagtggctaaacaaaggtgccgcttgagagatgcagacagaaatcagcctctgctttaagaacaagttgctacgctgaagaatgagaagaggaatggggcccagaggctgaaggtctggaccaatctcccttcccagataagcgcctggaccctcgttcctcagaagccacgtgtaattaccagctctttttggctacagagcacatgcccaggaggcttggagaagcaggaatttaaaacatgctagtttcagagccaagattggtgacaacaccatcagttactgtttgggcttcgggaagccgtgggctgcagcactgggtctggtgtcctgggctgtgtgggacctcagcaaggttgtttcctgaaatgaaagctcctcttctgggggatgacacaccaggaccacctgcagatgatgtttatgaatcccccagcaggggtggattgatcttacaatgggactgtgtaatataaacatttcattattctacaaaagaatacacacaataccacctaagggtctctaagaatagggttggagagtgacaatgagaaaatgccactcaaaaagaaatagagccgcattccttctacacaacattaatattaactttacatacaggggaaaaaaatggcattttaccttaagagttatttgtaaactctctccacaccatgagataaaatcagtgcagagctcagagctctgaatttcctcatttgggggctaatagactttaatgggggctcttcttggcatgcaaatgaacgtgtgtgtctctgagtgcatgtgtctgtgtgtgtacacacgtccctttgaagtttatttacttggtagcactaattgtaaaagggcacacccaggggaatttaatgaggcgacatgctagaatatagacattagaaagggaattaatattttcctcataatagcaagtaggtgaagtcaagtatgaggacagaaggaaagaaaaaggaaggcagggaaagagggaaggagaggagaggaacaggttttgatgatcgtagataagaaccaataaacactgttgcttcacactcccg

SEQ ID NO: 776 - DNA, 2246 bp, Homo sapiens
ttccacagtatcagatggtgtgggctgcaggtctctgcaggtgagggcttctggctcagctgctggggagtaagcaccaagtaggcacttgggccagaaagaccagggttgctaaggaaatcagatgaagggaggacattcagatgaagaaacagatcatttccaagcaagaactagcaagaactccagattccttatgtgcattcagatggtcttttttgaaaggtatttgggcttgaaaagcacatgtactttatcagctgtgtacctctgctattgtacaaggaaagcctcattctcttctgtccggataccatccttcaacaccctactcaaatgccgcctcctccaagaagccttcttccctccacttggaagtaaaatctgcttctctactcattcctctctcatggtcctcatctcatgccatgttctgttctagctgataacatttacatatgtgactcagtggtatacctcatgtatttgacacacagaacggatcattttaatgaccctctgctctataagacaaaagtattttcagtcatatttatgtaaaaatcagcaatcatcactactttctcgatttcttctttagttataaagcagtgaacaatttttaaaaagacaaatacattttaactttaagatattcaaatgcagtaaaaatatttttcgtatgagtccaaatttttacctatcaaacaagatgttacaactcattgttcacaatctgttttgttgctttaaattttaaacacatatgagaagcttacaggggtcacctaggatgagagaattgaaataattcaagttctggttttttgtttgtacaaccactacgctatcattttttgtttcaaatctactgtttacatgcagaagcaggtaataagtgccactgaggttggagacataaggacgtcaaaggatctgaaccatcgcacacttactcttgcaacaagaacacgcccctgagtctgtgcatgttggggccaagtgcataaccgggagttctccagattaatgtcaatgtagaacacaatatttatgaaaggataaataataaagatgtgatgaatttgaagcttacatatacttactacataaaatccaacagtaaccacggagattgtttagaacttaggccataaaaccatttttttctggaaagagctttgcctttatcgctgatactctttcttttgggatggagtttcactttgttgcccaggatggagtgcgacggcgccatctcggctcattgcaacctctgcctcccgggttcaagcaattctcctgcctcagcgtaccaagtagctgggattacaggtgcccatgaccaagcctggctaatgttttgtatttttagtagagatggcattttaccatgttggccaggctggttttgaactcctaacctcaggtgatccacccacctcggcctcccaaagtgctgggattacaggcgtgagccacggcgcccggctgacattctttataattgtgataatgacaggcagatcagcttttggttatatttgtatttaaattctccacagacggttgctcttttattgatggcacatcccccctccacccagtcccatggccccctattccctccccaccccactcccaccccatttgactgtaaattcctgcaaggtggggacggctgtgcagccccctgttgtacagtgcccactgcacaagcgcagtggtttgcaggccaaggccccagggagatcgccttaggatgtcctcccttttcctctatgggaggccagattttcttcctacatttcaaacaaagcaatacatcacaacagactgagtacagaaacaggtaagataatccagctgtcttgggaagccagatattagagagatttgcaacatttctttgtaaaacaatgtcactcttctccatttaaaacttatttggaaaatacaagttatttttcataaaattacattatatgtgttaacatgcaagggtttattatcattttaaaaagtgttagcagattttaaggatttctcagttttaatttctaatgaaggaaatattgatatctcacataataaacactgtttggggtcctcagtgatttttaagagaggaaacgtgtgaacagagtgtgtgagttgtactcaggcactgcgttacgtatggcaggtgctcatgtatgcttgtgacactcatgagtgactacaaaaaggattagactgaaccgaat

SEQ ID NO: 777 - DNA, 2801 bp, Homo sapiens
acttcatgattaactccccaaggtcctgcatattttctcaatgggccaccgcgcccggccagaagatttttatggtaaaattttgtgatgggaaaactcatcccggaaaatgttgagacctgatgctgagtcctcagcagctcagagaatacgtacttctgtcccaggtcacccaaacattgacctgtgtcggttccccactaggaacaaaatgtaactgaggacgttgtcagatgcttgtcctcgtcaccctgagcttgttggctgctatctaattcttattctttcattttcttgcccgcacgttcttgatggcagatcactgacaacagccattggaagcttaggaaaagggtatgtgccgggcgcggtggctcacacctgtggtcccagcactttggggggctgaggtgggcggatcacgaggtcaggagatcgagaccatcctggctggcacggtgaaaccgtctctactaggactacaaagattggccgggtgtggtggcggtcgcctgtggtcccagctactcgggaggctgaggcaggagagtggcgtgggcccgagaggtggagcttgcagtgggcagagatcgtgccactgcactccagcctgggccagggtgagactccgtctcaaaaaaaaaaaaaaaaaaagcatgtgtaacgtgaaaaaatggacactttagccatcgcctgactttctgttgaattgggaaagagcctcctcccgtccacatgggatggccttcctgatgtggctctccaagaccatccctggagggcataaaacctcacaaatgcatcaggccgtgtgctggggatggggcatcgtcacgccaggtctgactaggaaggaggatggggaggcagggctgggggctttgaggtcgaggcgtggccgtggattccagaaagccccttggctggtgtgcgtgcctgcccagcggcatccgtgtatcctaacacctgccctccgtgtccctgcatctgcaggccatgtcaaaggacgccctgaatctggcgcagatgcaggagcagacgctgcagttggagcaacagtccaagctcaaacaacttgtcaatgaggatttacggaagcaggaggagtccgtgcagaagcaccatcagaccttcttggagtccatcagggcggctggcaccttgtttggggaaggattccgtgcctttgtgacagaccgggacaaagtgacagccacggtggctgggctgacgctgctggctgtcggggtctactcagccaagaatgcgacagccgtcactggccgctacatcgaggctcggctggggaagccgtccctagtgagggagacgtcccgcatcacggtgcttgaggcgctgcggcaccccatccagcaggtcagccggcggctcctcagtcgaccccaggacgtgctggagggtgttgtgcttagtcccagcctggaagcacgggtgcgcgacatcgccataatgacaaggaacatcaagaagaaccggggcctgtacaggcacatcctgctgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccactgagaagataagcgaggacctcagggccacactgaacgccttcctgtaccgcacgggccagcacagcaacaaattcatgctgatcctggccagctgccaccccgagcagttcgactgggccatcaatgcctgcatcgacgtgatggtccacttcgacctgccagggcaggaggagcgggcgcgcctggtgagaatgtatcttaacgagtatgttcttaagccggccacagaaggaaagcggcgtctgaagctggcccagtttgactacgggaggaagtgcttagagatcgctcggctgacagagggcatgtcatgccggaagatcgcacagctggccgtgtcctggcaggccacggcgtatgcctccaaggacggggtcctgaccgaggccatgatggacgcctgcgtgcaagactttgtccagcagcaccagcagatgatgcgctggctgaagggggagaggcctgggcccgaggacgagcaaccctcatcctgagtccatggggagaccacacctcacggagcctggccgcggacccctcccacccctgcctttgcggccccgcacatttaggaaatactccccgtaataaagtcccacgggggccgcaccgctgtgtctattggctgacacggggcggggtttggggccccctaacgtccccctggggtcaaaggtgacagaaaaggcagaagctggggctttctggaggatttaaccacagaggggtgggcttcacaggaggtggctgccacggcggggccgggtgcccgtgccccatcctgaggccgtgcatacgcgggtgccccttcgcctccctcccctccgccagagctgcctgtggccagacacacggtggagggaagtgcacgcgaaacagacacagcggcttcaaatagatgccgcccctgcccgcgctttgcagctagtccctgcaaaccttgatgatggggctgggcgcggtggctcacgcctggaatctcagcgaggccaaggagagtggatcacctgaggtcgggagttccagaccagcctggccaacatggtgaaactccatctctcct

SEQ ID NO: 778 - DNA, 1878 bp, Homo sapiens
taagaaattagacagatggcaacacaataatagtgggtgacttcaatactccactgacagccctagacgggtcatcaagacagaaagtcaacaaagaaacaatggacttaaactataccttagaacaaatggacttaacagatacctacggaacattctacccaaaaactgcagaatatacattattttcaccagcacacggagcattctcaaggatagaccatatggtaggccacaaaacaagtctcaataaacttaagaaaactgaaattgtatcaagtaccctctcacaccacagtggaatacaattggaaattaactccaaaaggaaccctcaaaactatatacaaatacatggaaatttaataatctgctcttgaatgatctttgtgtcaacaatgaaatcaagatggaaattaaaattttttgaactgaacaatagtgacacaacccatcaaaacctctgggatacagcaaaagcggcactacatttagtaagttcacagcattaaatgtctacatcaaaaagtctgaaagagcataaacagacaatctaagctcacacctcaaggaactagagaaacaagaacaaatcaaactcaaacccagcagaagaaaagaaataacaaatatcagagcagaactaaataaaactgaagcaaacactacaaaagataaatgaaacaaaaagctggttctgtggaaaaataaagaaaatcggtagaccattagcaagattaaccaaaaaaagaagagagaagatctgaataagctcaattagagacgaaatgggagatactacaaccgataccacagaaatacaaaagatcattcaaggctactatgaacacctttatgcacaaaaactagaaaacctagagaaaaatggataaattcctggaaatatacaacccttctagattaaaccagaaagaaatggaaactctgaacagaccaataacaagtagcacgactgaaacagtaataaaaaaattgccaacaaaacaaagtccaggaccagatggattcacagctgaattctatcagacattcaaagaactggtaccaatcctactgaaactattccaaaagatagggaaagagggaatcctccctaaatcattcaatgaagccaatatcgccctaattccaaaatcaggaaatgacataacaaaagaaaactagagaccaatattcctcatgcacacagatgcaaaaaccctcaacaaaatactagctaaccaactccaacagcatatcaaaaagataatacaccatgatcaagtgggtttcttgccagggatatagggctggtttaacatacgcaagtcaataaatatgatataccacataaacaattaaaaacaaaaatcatatgatcatctcaatagacgcagaaaaagcatttgacaaaatcaagcatcctttatgatctaaaccctcagcaaaactggcatacaagggacgtaccttaaaagtaatgaaagccatctatgataaacccatagccaacattatactgaacagggaaaagttgaaagcattccccctgagaactggaacaagacaaggatgcccactttcaccacttctattcaacatagtactggaaatcctagccagtgcaactggacaagagaaagaaagggcattcaaatcagtaaagaggaagtcaaactgtcactattcaccgatgatatgatagcatacctagaaaaccctaaagactcatccaaaaagatcctagatctgataaataaatccagcaaagtttcaggatacaaaatcaatgtgcgcaaaccagtagcattgctatacaccaacagcaaccaagctgagaatcaaatcaattactctaccccccttacaacacctgcc

SEQ ID NO: 779 - DNA, 1556 bp, Homo sapiens
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagag

SEQ ID NO: 780 - DNA, 1992 bp, Homo sapiens
aataaaatacccaaaatgttcaggaatcaattgaaaatctctcattatactaagaatcgagaatatctcaactttaatgagaaaagaatcaataggcactaacactgagataacacacatattagaattacctgtcaataatttttaagcagccatcatgaaatgcatcataagtacttgcaaacacacttgaaacaaatggaaaaatagaaagtcttagaaaaaaatagaaaatataaatgaagaccacatggaaatttgtttttttcggacagagtctcgctctgttgcctagatgggagtgcagtggtatgatcttggctcgttgcaacctccacctcctggttcaggcgattctcctgcctcagtcccccaagtagctgggactacaggcacatgctgccacacccagctaatttttatatttttaatagagacagggtttcaccatgttggccaggctggtctcaaactcctgacctcacgtgatctccctgcctcagcctcccaaagtgctgggattacaggtgtgagccaccacacctggcccacaaggaaattttagaattaaaaaatacaaccaaaatgaaaaactcaatggattcaatgtcagaatagagaagatagaggaaagcatcagtgaacttgaagatagaacaatagaacttacccaatctgaacaaccaagagaaaacagacttaaaaaaaatagatagaatctgactcctcaacccctttggccatggcaggcaccttttggactgggctgccactgcttgggcagagtaaaaggtgccaggaggagcatgggggtggaagtcctgtcagccaaaaaataaaagtttacctcagagctgcaaaaaaaaaaaaagaaaaagaagaaagaaagaaagaaagaaagaaagaaaagaaagaaagaaagaaagaaagaaaagaaagaaagaaagaaagaaagaaaatagatagagtctcagggacctataggattataacaaaagatctaacactcctgtcatggagagagaggagaggggagatgggcttaaaaagtacttgaagaaataatggctgaaaactattcaaatttagcgaaagacataaatctccagattaaagaaagtgagcgccaaacaggataaagccaaagaaatccatatcaggacacataataatcaaacttctgaaagttaaagacaaacatagaattgagaaagagatgacaatctcttatgtataagagaaaaacaggatctctcatcagatactacaaaggccagaaagaagtggcacatttttcaagagctgaaagaaaagaactgtcaaaccaaaattcaatatccagcaaaagtatacttcagaaatggaggggagatcaagacattctcagatgaaggaacacttagagaatctgtcaccaacataactactctaaaagaatggctaaaggaagttcttaaaatgtaaaggaaatgataaaataaggaatcttggactatcagaaagggagaaaaaacaactgaaagaaggaaaatgtgggtaaatgcgatagactttaatgcttctggagttttttataaatgctgattgtatatcattgtctaaagtggttctgaaatatataaaggaaatacttaaggtaattataaatgagggaggataaagggacttaatagtaggtaaggtttctacacttcactcaaactggcaaaatgtcaataccagtacactgtgataagctatgtatgtatagaataagaaacactttatcaacaagagcacaggaaaaataaaacagaaatgaaccaggtgtggtggctcatgcctgtaataatagctacttgggaggctgaggtggaaggattgcttgaggccaggagtttgagaccattctgggcaacatagcaagaccccatctctaaaaaaaaaaaaacaaaacaaaacaaaaaaacaagaagaaagataaagaaaagagaaatgaagaacataggcaac

SEQ ID NO: 781 - DNA, 2819 bp, Homo sapiens
ttattgagccttggctgccggggctctggtttcaggaaaagcctcagtcctgcatttgtgaatttttaaggaggcaaacaaggtgaatttgaccttgctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcacctcatcacctcctctccacatgcccaggggtgcccctcccaaggctggctgggcaggtcccacggactaggccccaggaggagcagtgggcttcccccaggaaagagcagagccagcactgcctgcctagggagggcacccactaccaggcatggctggtggctccgtttaaagaaatctttgtccatgtgggagtgggaggtgcttcctcatcctgcctggaagccacgtcctggctcttaccgtggactctgcaacagccgtggtggccacatgaagatggaggaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccctccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcagtcaccctccctcacatccacccagagaggtccagacctgtggccacttccatgccctctccagaccaggagacacctgctgctgacctcgtggaaaacttagattttgacattctgatgcttcggaagtggtggctcctcctccctcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtctgatgtcatcagctcttcaacatgagacaaaagaggggattttatgttttgagtcattagaatgatataataattttctgaattgacatctggatgttgaaattaggatggtgcaaaaggggtccagggcctcaggctgggcgcagcagccagctcccaatgacgcagaagctgcttcaaaaccccctcaacaaagaggggcacatgcaagtcaccaaagtgggaagccttcaccaaggccacacccaaagtctactgattgtctgtccaaagttcgttgattcctggccatgaacaagcacaatagaaaaagacacagggtcctagtggctacaagtcaatgtgaattggcacatggtctagcagttttaaaatctgacagtagagtatggcaatgggcaagggccaagaagtcctgagatgggaggtcagcgctctaactgggctcagtggaggtctgtgaccagtgtctggacactagctacaggggaccgggcagaggattctgggcagaaggaaaatgtctaaaagtactttgggagggtaaaggacaggggccttatttaaaataaagactgaaggataataagtgtc

SEQ ID NO: 782 - DNA, 2119 bp, Homo sapiens
attgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaagtgcgtgggcaaggaaggtggtggtccctgtagggaagcagtggatgggcagtccccacggcctgtgggaatgagtcaggcttctcctgatctggcgctcaggaggtctctgattctggtgttggcctccctccttgccggtgccattactgtcacttgtctttcatctgggaaggcgattggcactgacctaggccttgcctcattagccagcaatgctggctaatgacccatttacaaccatcaccaaacatcacctattcagccattaaccaccgtgcatctttaccccttgattcttgttactgcccaccacccattatcagtgttaatgaacttcaccatcactgccttcttgaattaattttcattatcttgcctcttcactggtttttaatgtgcatgcccttcactatctctgccagcctccattcattcccacgattgagcattccccgccactttgtaacctgtctccattctccatgatccctcacctgtttcagcaccactgaatattgtcactaacttggaagccagccgcaccctgcatggggaagtcctctctctggagtccagcaagtcctagtgacagaacccataccatttccccagatagctttgctcctcgttcattttggcctttctccctttggttgggggccatttgcctctcccttctcccctgctgtgcctttcctctcagtttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttg

SEQ ID NO: 783 - DNA, 2275 bp, Homo sapiens
agtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgcggctgcagagtcagatggggcggggatttcggggcaccgggtcctcaccttcacgagaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaagtgagcgctgctgcccaagccgcctggctatgctcgatttgcaccagggttggcacggtcaggacgctgccagcagaggaaccctctgccagtgcacaatggtgttctcacctggtggccctcagatgtacacttccccagagggcacagccgtgaaacttcacatcagtttcgctgtgcattgctgggacactgctgtatacctcgacacatgccaatcctgcacacgtggctgtccgtggagcttggacatgccccactgagcacagaccttcagatgcctgtcctcagcccccaagcacacacactcatgtacacacacatttgacaaagtcacacttcataacctcctaatggtacacaccccaccaagatggccttttcttttcttttttttctgagatgcagtctcactctgtcaccaggctggagtgcagtggcgcgatctcagctcactgcaacctccgcctcccgggttcaagtgattcccctgcctcagcctcctgagtagctgggactacaggcgcgtgccaccacgcccagctaattttttgtattttagtagagatgggtttcaccatgttggccaggatggtctcgatctcctgacctcgtgatctgcccacctcagcctcccaaagtgctgggattacaggcgtaagccagcacgcctggtcctttattttcttttcttttttctttcttttttttgagatagagtcttgctctgtcacccaggctggagtgcagtggcgcggtcttggcttaccgtaacctctgcctcctaagtagcttggattacagatgcccgccaccatgcctggctaattcttgtatttttagtagagacggggattcgccatgttggccaggcttgttttgaactcctgacctcaggtgatctgcctgcctcagcttcccaaagtgctggattacaggcgtgagccaccatgcccagcccagatggccttttctctcagcccactgtgacctatggggccaccccttctccctagcacctaagtgttccctcttgctgctagtgctgcctggaggtttggcggcgggcaggagggcctggggctcaccacagccacagccctcttgcagcttcgcggcagcagctaattcaccccatctgggttttatttatagttcccatccgctcttgtagggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggtcgcgccccactgcgctgctgaccttcctgcagttccagacacctcccacaataaagagctcctcctctgt

SEQ ID NO: 784 - DNA, 2657 bp, Homo sapiens
agaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttcttttttttttttttttttttttggacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattg

SEQ ID NO: 785 - DNA, 3206 bp, Homo sapiens
aaagattaaatgtaagcgctgtcaccaggccttctgagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcgcttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaat

SEQ ID NO: 786 - DNA, 2606 bp, Homo sapiens
actcaatgctcaatgttgcccaggctggagtgcagtggcgtgatctcagctcgctacaacctctacctcccagccacctgccttgcctcccaaagtgctaagattacagcctcttcccggccgccaccccatctaggaagtgaggagcgtctctgcctggccactcattgtctgggatgtgaggagcgcctctgcccggccaccccgtctgggaagtgaggagtgcctctgcccggccgccaccccatctaggaagtgaggagcatctctgcctggctgcccatcatctgggatgtgaggagcgcctctgtctggccgccccgtctgggaagtgaggagcacctctgcccggccgccctgtccaggagtagagacggggtttcaccgtgttagccaggatggtgtcgatctcctgaccttgtgatctgcctgcctcagcctcccaaagtgctgggattacaggtgtgagccaccgcgcccggcctctcgagctcatttttaaggtaacgctgctagggttctgagtttgagaagggatcttctaaaggtaagcttaatattgcaactttcaccacagggcctctgtctaaattgcatttcaagtggaaggaaaggggtgtaagaagtgaaatagaattttgctgcagaccaaaatcattctacaaaatgtagaaatgataatagcttaccacaaattcagcaagatttaacgccaagtacagcggtgtagactttacaagtatccacttccgttgggtgatcagacaagctgaagggacacacaggatttgggacagtagccctttagacaatgctgggtgttgaagacagaacttcatcgtaaatccgtatgttctaatctgatatttatacaggctatgatcgtctcctgaaatgtttcccaattctttatatgtcttttaaagcacaatttaacatatgctaaaaaatttccttccgcatccaccagttttgaatttaaactcaactaagtctgccaggtcatacaaaccacaccttaatcattctaagacaactcttaaaattaatctacttgtattgttctgcttgtaccttaactatggcataatgaatttgctaattcaaaatgttgcagagccagtaaccccagtgttatctgcagaccatctgaggtacttttaagcatttttttgaattctattgtttgctttgaaaacatggggtttaaacggtcaaggaaaatgcgttttgtctcgtcattcaggagctcttcgggacacgcctgcagtgttgcagacaggatggaatgcaggcaagagggttccaactcagagcgcagacccttgggaaaagcacttggtgggtcatcctgaaaacttcccatttccggcagtttttgatggcatggcagtcgtgacacctgaggctctcctttggggcactgtcctctgtggccgtgggtggccctgggccctcctcccagccagtcccgccccagagcttcaacaccactgcaggacacccgagcaaaatactctgttggagcagggaacaaacccacggctgcgctcggagtggctgctgaggctggatttcttcttactgattctttcacatatggaagaactgggccgccactgggaagcgagaggccagccctgctcggatcctttctcatttccagtgataatgcctcactctgaatttccatcagccgcaggcttattcatccaggagggtgcatctgcaggccaagggccctccatcggcattctttgcttaaggctgtatgacagtttgtccgagtcacctcctccggcccactgcacttgtgccaggcaggtgccgaggggccctcttctgtccctcatgcttcgtgttcttggatgccgtgggcctgaggtcacgccttcgtcagtccgggagggccttcaatggatctcaatatgaacctataggcggacgttgagcatcatggaagccacgatgtagaagtaggggaagttgatgcgcagccaccaggccagattgaagaagacagcagcttgcgagtcagccccttgcgtaagactccacaggagcgggcggcggctgagcgctagagccggacagccaggcgcgacagagccgccgccatatagagaccggcgctcccacagcccgcctgccctctccgcgccgcgtcgctcgggccgctggccttcgcttggcgggctcagggagcgagggaggcggcggctagactggcgggcgagcgggctgcgggagcggagtccgcgcgtcacgctcggagaagcatctccgcgagctgccgcctggtcccccagttcactgtattttttaaattttctttgagacttccttttgacccatggattacttaaaagtgtgttgttttgtttctagtcatttgaatatcttcctgttatctttgttattgatttctcatttgattccattgtcattacaaaacacactctatatgatttcacttatttaaaatttgttgaggcttgtttgatagcccaggatatgacctatcttgggatatatattttgtggtcatttgaaaagaatgtgtattctgatgttgctaagtggagtggaccataaatgttgatttg

SEQ ID NO: 787 - DNA, 2420 bp, Homo sapiens
tgtccagccaatgtaatcagttaatacatatctaaggaaatttaattttggtcatactaatgttacatcagccctcaaaagaaaatgctggtagagatgactattaagaagaaattagatctttccaatgaatggtgtttcacagtaatagttgaagtctcagacaattcaagatcagccctgaaaaggggtacatccagattgacaattagaatcaaagtggaacagcagaagaacatgaacattgcagtcattctttcaactaatattaattccacacctaatatatgacagccactgtgttaggtcctcagagaatttataatctagtggaaagacaagacagataacagataatgagaatacaatattatgatgtcagcagaccccaggcataaaataagatgacttatagggttcgtttgacaatttgaggtaacataccatattttatcaattttaagaccatgagttgtaacaaacaccattatttttggaccatggagggggccggagggaaatgctgctacttaaactatgacacatagaatttttccacattgtattgaattctgctaagagcattagtgatgcaacattttttaaaataatattccactattatctttgggttttttttgcaagctgttggggtccattctatgagtttcaatgctggtgctttcttattgcaactcagaggtatcaatgaagggttttcagatcacaaccaggatttaaatcctttctttaaatgattagttgactgaaatgtcaagggtttgcagttgtctaatcatgccaccaggaataaccaggaagtttgcacatgttcaggctaagacaactacatcacaactaccttctggtgacagcattgtaagacaccatgattgtaagatgccattccagttttagaaatattggaaagatgtacatcttagatttggcaaaatatcatttattgctggcagctattaaaatatgtgttattaggagaatgtacaaagagcactgtgagcactgaggatagagcacctaactctcacaaaggaagtgatatttgggcagacagaagtcatgaggatgcatgaatgggtaagaaagggcagtttcgagctgcaactacatgtgtgggagagtggtaggaccggatgctgggccatgtcaagaagagtttcatgtgctcaactaaaaaatttttgaatcttattatttgggtgatagacaaagttttggggtcagggagtgaccctgatgatataatttggctatatcaaatctcatgttgaaatctgatccccaatattgatggtggggtctggtgggaggtgattggattacggggacaagtccctcatgaatggcttggtgccattgtctgaggattgagtgaattctcactctttgtttctgcaaggtctggttgttaaaaagagcctgggacctttctcccgtttccctcttgcttcctctctcgtcatctgacataccactctctttccccttccaccatcattggaagcttccaaaagcagaggctcgctctttccttgcctaacgcagccatggcttgtggtcccaagaagcatctgaagtgagtagcagctccaaagcactggatgctggataaattgaccagtatgtttgctccttgtccatccaccagtccccacaagttgagagtgtcttcccctcatcattttcctaaggaacagacttaagtatgccctggaaggagatgaagtaaagaagatttgcatgcagcggtttattaaaattgatggcaaggtctaaactgatataacctaccctgctggattcatggaggccatcagcattgacaagacagaagagaatttctctctgatctatgacaccaagagtctctttgctgtacatcatattacacctgaggaggccaagtacaagttgtgcaaagtgagaaaaatctttctgggaacaaaaggaatccctcatctggtgactcatgatggtcgcaccatccgctacactgatccccttatcaaggtgaatgataccattcagattgatttggagactggcaagattactgatttcatcaaattcgacactggtcacctgtgtatggtgactggaggtgctaacctgggaagaattggtgtgatcaccaacagagagaggcaccctggatcttttgacattgttcacatggaagatgccaatggcaacagctttgccactcaactttccaacatttttgttattggcaagggcaacaaactatggatttctcttccctgaggaaagggtatccgcctcaccattgctgaagagagagacaaaaaactgccaaacagagcagtgggtgaaatggtcccagggtgacatgttagatctttgtacgtaattgaaaataatgtggcaagattaatagc

SEQ ID NO: 788 - DNA, 2354 bp, Homo sapiens
ttctcttttaagaagccaaagaaactttgctggttctttcatcctttctttctctctattcctctttctactctgtttcctccttctttctttcttttcctgcctcctttcccctctccctccactgtcttgggatatgtcttacccgcgcaggagttcatccgctgcatccaagggtaaaccgggctcgtgtacttccggtcggcgccttcgtcatggagtgctttgccctgcccgctgctgctgtcggaattccacccacgcacctattccccctcccagcgcttcagacacctctctcatcgaaaaaccgggcgaagggaagccggcaacgagcggagaactctggctgaattaacggtggctcccagaagctcctgcccctctgacagctgtcgcttgggcagcccgagagaagaattgtcctctttcctggtgccagaggacgcaggaaattagccaggttgcgagttgcaaagctgctgccgcggcgccgggaacggagcgcgcccaatctccagcgggagccgccaggcctggcctggcctggccggggcttcccttcgctcgccatctccggacaaagcacagccgagcccggctggaaggcagagctccgaagcaggcaggacggagtggagcaaaagaatgcggctctattctcgcaagggaaattataaaaaagttcatgttcacggttctcatccacatgaccgacagcggccaatggaagggccgaacaactcataaagttgtattgcaaagttgtaaattttcataaacaacaacggatttatgaccctttccccatcactgagaggaggcagctcttacaccggcgccatcttaccaccgaggccgccccgacttggggcctcaggttttacagacccttttgggccaggttttactaaaagagccataagaagcgggcccagcccaggcaggagactggagacgaggtcttgcaggcggaactcaggatgctctgagctgcccgcacaacccctggaccttcacccctcgccccttccccgcatccagctgccccagcccctgcccaggctgcgtagcctagcgggggtctgcggtcctagcccctccccgcgccacctactgcagtgccggaccctggggccccctcgcctggtctgcaggcggggtggggaccttaaatcccatttcctagcctggggctgggttcagggcgcatgcgaatccggaatcagctctgggtaatgcccctttccaagcccactgctcagccttagaggaaagtgtggatttgaaatttcctcatggaattgatggaggtttttaggtagattcatagaatataacgtatctaccaaagattccgttttcaagggatctagaagatgttagtgcacacgcaaaaaccagacaaacgtctctacacggataaaggcacatatacaattatgcacacagggaagggcatacactctattgtgggcacagaatgacatgcaattatggacacacaaaaacacatgcacccaattatggacaccaaaatatatacaattgtggaattaggtaaaaacacacacacagaaatacatacacagaaaaataagcacatactcatacaaatacacacataaaaatacattaaaaagatacatgacaccaatacatgggtacccaacacttggaccatcacaaggacagccaccccacttttgcttccccactgccccctgccctccagccatactcacctcccctttcccagtcccctctggataaggcagtccacatttttctttgtcaccacgcatctttattttcggttacataaaacacagctgggctgggaagtgtgccttccctgaaccccaggatggagctgagcagggtacaggacaacacaggagatgaagggcattgcggagggcattggacctccccacccactacagttaactcaagacaacataccatgctacaaagtcaccccattaacacatcctttccaagtcaagacactgccttacaaatgaactccaagactatagaaatgataaaaaaaaatcttgttcaaatatacagtatctgctattataggaaacatcagggcgtacatatttaacacagctgaacagtaagatacaggagccagaggaaaggacagcgaagctggaagcatctccacagtcctgctaagcagaagctaacccacagatctgcagccagctcaggaacattcccctccagaagtgggggttgatgggcctgagctgtgggtgccaagccagagaaggagggattgattctagggtgcaagcacttaggatgctttttggaataaatatattatttttcgattt

SEQ ID NO: 789 - DNA, 2064 bp, Homo sapiens
acttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccacaacctccccggtaccttcgagtgcatctgcgggcccgactcggcccttgtccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccaggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacagtgttgaaaatgttcagaaggttgctctagattgcgagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaagaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgg

SEQ ID NO: 790 - DNA, 2630 bp, Homo sapiens
aggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccagggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggctaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcccggatcctggataatgtttccagggtgttgggaaggcctgcgtctcaggtcacagttgtgggtgtggccctgcgccgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcacgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagtgcagaatcaggtccccacggctgttgctcaataaaagtggcggaataaagtgc

SEQ ID NO: 791 - DNA, 1955 bp, Homo sapiens
gacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaagggtgagggcggtgggcgggcgggggactgggtcccgggagtgagtactggccggggctgggtgtctgcggtcaggaggagcggcttctcctcctgtccaggagccgtagggggaggcggggggtgtcacagcaatggctcctgctgctgccgaaacccgggggaggtgagagaggaggagacccagtgtactggaagggaactccgaaggaattaaaggaatgggcgggactaggggggagaaggaggggccccccggtgggcggggccaggggcgggaccataagggaggtgttcgaccaggagagatgggcggggcttaggtgggtgggccgggtcagcggcgggagacagacttcaaggagcgaggcaagactaacggaagtgggtggggctccaggcgacaggaggaacttggggcacaatctctgcctggggaaagcatctccttgaatgaaaatcacagacaaatctatgcagaccactgaaatcatttcactgtggaggtctcccaaagacggaaattgtcccaccagcgcctgtcctacctgcagtccccaccaggctgcgcaaacggccctccagccagactagcccctccccatcctcctccagggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgaggggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctgaccttcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaacttgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattctaccattcattttaattcctttgggtcttgcagtttttcaggaggccttgattaaaatgcaaatacttgtc

SEQ ID NO: 792 - DNA, 1827 bp, Homo sapiens
aaaagcaaccaaagcttccagggtgtacaggaggtccaaagtcaccagaaggaagaagaaaacctgaaacagcgagagctggccaaacgctgctaagacctatgcaaataagacccacccacgctacctggaaatcgggcctgggaagtcagaaaacaaagcacatgcgtgcagggctgcacgaacggaggcggagaaggcggctccgagggagcagctgatcctgaaacagcagtggatccctgggagagcagcacagataaagatccaggcaataatgatgcttcctcctcttggacagccttttacagttctggccatggaacttcagagaaggtaggtctgatttggggggaaacaggagatcttgacgtgtagtaatacaagcttactggagtaaagttagaattttcaggtaagagaattaaaaaaaaaaaaaaaacttataatcttgcccccagagataaccactgctaatatctggttgtttatctctccagacattttttccattgcacacacacttttggaaattggattatatggtaatatggttttgttgctggttctttttcgcttaatgacattatatcctaggtatatatccatattaatagttttaccacatcatattaaaggctgcataatatctcttcctatggatggagcagaatctacttaatcaatgtcctattactggatgatgacgtagttctccatacgtcaccgttaaaccagcgcctggatgggcatctctttactcacatctttgcagaagtccttgatggtttccgtggaatcgattcccagtgggggaaatgatgagtcaaggttacatacagtttacggcctctgcagatcaactcttcaaattattcgaatgacccatatgagaaacagagaaaagccaagtatttctggttgaaacggagaagctgggctggagtgcgcctccctccaactccccgctttaactccctaaggttggtgggatggccagctctaagatctcagaaggctgaccagctgtgtgctaagaacaaagcagaaggcagcgaggacgtctcccgcgaggcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcaccctgctccgcctggagccccaccatgtcatcctggaaggccatcagctgtgcctcaaggaccagcccaagagccgctacttcctgcgccagcctcgagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattt

SEQ ID NO: 793 - DNA, 2102 bp, Homo sapiens
gagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccacgtctccagccggaagtcgtctagccctgccgtggtggcctcctacctccacgaggtccagcctcactccccacacttcctgaagctgcttgtcaacttggccgatcgcaacgggaacacggcccttcactacagcgtgtcccactccaacttctccatcgcgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccatgatggatcctcggccctcatgctggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcacaatgccatatgtacagtcttgactatttctgagtcatctagtggctccaatttgctccagggaaattggaattaattaagaaatttattagctagtaagttgctatgtaat

SEQ ID NO: 794 - DNA, 2946 bp, Homo sapiens
aaagcgaagctttacggcagcccgtctcccgttaggagccggggaggcaaggtccagcgtacggtccgggggaaccttaactgtcgtttctgtgcctggacagtaggttggagagtggggtctgaatgagctacagtagtgaacgccgacggcttgtgttgagggcaggaaagggtgcacacagctccggcaggtgcttccgcgaggtgagatgagtgccgcgcgcgccgggctaacgtgcacgcgcactcgtgcggcgcccgcgagccctcacttcctacaacccgagaccctccggacccgcgaccccggacccccgtccccttctccgcgcccggctgggcagcgggcagcgccggaccctgatgggctctcggcccttactgcccctgcgccttgcggccctgagaacaagacgtgagcaggacggatagcgcccggcactcatgtctgagtttgcattttgagcagtgagaaaggttaagaaacgaaatcctcatacttgacataaaggaaagggtgctgggtggtcagacagctgtggacgaaagggctcaggggttttggggtgtggggcccgggaaggcgcatctgagtggtcgcagtcggggaagggggttgattaagtacacaccggctgtaaacattgattccatatcggtcaatgtggggcttaggtgaggcgttctgacccagcaatgaaactggaaaggtaggcaggggccaggattccggactttgggacgtttttctgagtctatggggtctattgaaagattttagaaacaatttacatggtaagatttgtattttagaaaggtgactgatacaacaacgtagaggaccctgcaatgtggagaggcatgaaactggaggtccagtgccgtgagttaacaatcaagacgtccatacaggagatgcattggtggatgggtgaagagatgataaaacggtacgtataataaaatgctggccgggcgcggtggctcacgcctgtaatcccaccactttgggaggctgaggtgggtggatcacgaggtcaggagtttgagaccagcctgaccaacatggtgaaaccccgtctctactaaaaatacaaaaattagttgggcgtggtggcacgcgcctgtaatcccagctactcaggaggctgaggcaggagaattgcttgaatcgaggaggcggaggttgcagtgagccgagattgcgccacggcaatccagcccgggtgacagagcgagattctgtctcaaaaaaaaacaaaaaaattattcaactgtgagaactcactccccaaaaaaaatgttttgcaagcaactcattgaaaaatggtctctattaaaaagcacgttaatacatccatatttaaatggcttgaactctttatcacctttcattattttttgaactgtggaggatggcatgcctaactcagaaaatatttttcaggataattcagtggtgatcttcagaagaattccacaaaaaaccaaattaacagatgaaacaatctcataagccacttgaaactgaatttctctagaacaagagtctataaaattttttgatcaaacacccactggaaaaattttttagcgtggacacccagtatttgaagttcttggtaaattactgtgagtaaagatttaaccaaccccttgtccttatctatgaacaaacttcactttgtgttaactttaacttgtcatagaaaccttatgaaggcagagtgttcattgtggtataaaacaacattggttgtaggccaggcgcggtggctcacgcctgtaatcccaacactttgggaggccaagacaggtggatcacctgaggtcaggagttcaagaccagcctggcccacatggcaaaaccccatccctactaaaaatacaaaaattagctgggtgtggtggcacatgcatgtaatcccagctacctgggaggctgaggcacaagaatcacttgaactcaggaggtggaggttgcagtgagccgagatcacaccactacactccagcctaggtgacaagagtgaaactccatctccaaataaataaataaaacattgctcatggtaaaaatgacctctgacatgtagactgcctctggcttgaaagtactgaataatcttaaaacacctagtgggaagccatacctttagcctctgttactgtcttaactgaatgtgggaatctaaaagacaaactcagggaactggtttcccgccggtcaaggacttccaagccaagcccccacccataatggtttgctcctgaattgcatttgggccaaagagtagagctcttccatgcctgtaccgcagtgaagtgtgtttcttctcctcagtcctccaaagtggagctgctgccaggcgtggcattatatgagtgtcaggggttaaacctaagaagactacctagtgagcgctgcagtttcatacatatcctactgaaaatcttaaaagcaagctttgcttttttgtaaataaagcgaatatagaagtctttctcgtctcagtaatgatgaactggaaattctgttcccctcctccaacaaaacagattctgtggaaaacattttttgttgtattgctaggttttaggaataatgtttccaaaggatcaagaaggaagcaaaacgctgggcacagtggctcacacctgtaatcccaatgcattgggaggctaagcaggtggttatcacttgagccaaggatttcaagagcagcatgggcaacatggcaaaaccccatttctacaaaaaataaaaataaaaatagccaagcatggtggtgcatacctttaactgctttgcataactactctggaggctgaggcggaaggatcatctgagtccaggagttcgaggttataatgagctgtaatagcaccactgcactccagtctgggtgaccaaacagaaccccatctcttaagcaaaacaaac

SEQ ID NO: 795 - DNA, 1894 bp, Homo sapiens
caatgggctgggccgcgcggccgcgcgcactcgcacccgctgcccccgaggccctcctgcactctccccggcgccgctctccggccctcgccctgtccaacacctacgccaacctgtgccagcagcgagccggtgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 796 - DNA, 3180 bp, Homo sapiens
ctttttctttcttaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaagcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcaatttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaact

SEQ ID NO: 797 - DNA, 1990 bp, Homo sapiens
atggccagactgcttctctagattcctcctcgctgggcagggcatctcggatggaagggagacagccccagtcaggggcttacagacaaaatccccatctccctgggacagagcacctgggggaaggggttgctgtgggcacagcttccatagatttaatccttcctgactgctggctctgaagagagcaggtgaccctgacaagagggattctcccagcacagcacgtcagctctgctaagggacagactgcctcctcaagttggtccctgacccctgtgcctcctgactgggagagacttcccaacaggggtcgatagaaacctcatacaggagagctccggttggcatcaggctggtgcccctctgtgatgaagcttccagaggaaggagcaggaagcaatttttgccattctacagcctctatttgtgattcccaggtgaacagggtctggagtggacctctagcaagctgcaacagacctgcggaagagaggcctgttagaagaaaaactaacaaacagaaagcaacaacatcaacatcaacataaaggaccaccacacaaaaaccccatccaatgtcatcagcctcaaagatcaaaggtagataagtccatgaagatgagtaaaaaccagtgcaaaaacactgaaaattcaaaaaatgagaatgcctcttctccttcaaatgatcacaacccctctccagcaagggcacaaaactggatggagcaggctgggtgcagtggcttgagcctgtaatcccagaactttgggaggccaaggctgaggcaggtggatcacttgaggtcgggagttcaagaccagcctgaccaagatggtaaaaccctgtctctactaaaatacaaaaattagctgggtatggtggcaggtgcctgtagtcccagttaattgggaggctgaggcaggagaattgcttgaacccaggtggcagaggatgcagtaagccaagactgcaccactgcaatccagcctgggcgacagagcgagactctgtctcaaaaaaacaaacaaacaaaaactggacggagaatgagattgacaaattgacagaagtaggcttcaaaaggtgggtaataacaaactcctctgagctaaaggagcatgctctaactcaatgcaaggaagctaagaaccttgacaaaaggttagaggaattgctaactagaataatcagtttagacaggaacataaatgacctgatggagctgaaaaacacagcatgagaactctgcgaagcatacacaagtatcaatagccaaatcaatcacgcgaaagaaaggatatgagactggagattaactcaatagaataagtcgtgaagacaacattagagaaaaaataacaaaaaggaatgaacaaagcctccaagaaagatgggagtatgtgaaaaaaccaaacctatgattgattggtgtacctgaaagtgatgtggatattatccagaagttccccaacctagaaagacaagccaacgttcaaattcaggaaataaaaagaacaccactaagacactcctcgagaagagcaaccccaagacacaaaatcatcagattctccaaggttgaaatgaaggaaaaaatgttaagggcagcctgggcaacagagcgagactccatctcaaaaaaaaaaaaaaaaaaaaagcaaagaaaagaattttcaacccagaatttcatatccagccaaaccaagcttcgtatgcaaaggagaaagaaaatcctttgcagacgagcaaatgctgagggattttgtcaccaccaggcctcccttagaagaggtcctgaaggaagcactaaatatggaaaggaaaaaccagtaccagccactgcaaaaacacatcgaactataaagtccaatgacactatgaagaaactgcatcaactaatgtgcaatataaccagttagcatcatgatgacaggatcaaattcacgcataactattaattttatatgtaaataggctaaatgcccc

SEQ ID NO: 798 - DNA, 2315 bp, Homo sapiens
ataaaataaaataaaaagaatgggaatatatgctatgaattctttgtggggtttttttggtgaatatttatggagtgtttgctgtgtagcaggtgttgctctaagcagttttcttatatcaaacacacttaattctccccagcaacctatgagagaggtaatattcccattttacagatgaacaacagagaggttaagtaacttgccaaggccaaacagctcgtgaatagcaaacctgggctagaacccaggtaatgtggctccagaacccctgcttttggtcgttctgctattctatgaggtagtcattatgatccccctcatcagaaagcagaaagcatgagattcagaggggtgcaattacttgtccaaggtcacacagctcatcagggaaggagctggtacccaggcccagatgtgtgggtcacacacccagactccaggccacctcccagatctgaggccgctcctctggagtcaagtctgtgcctgggagaagcaggaaggaccactggacctgctgtcagtggggcaggcacaggctttttccagtcccaggctgccccctactggcagcaggacaaacagcaggtgcctgggcccagctaggataggaagggtgaggatgggcctaagcaggctgacacagggctgagtcctcctctccccgctccagttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgt

SEQ ID NO: 799 - DNA, 1785 bp, Homo sapiens
gagcggcgagggggcgggggaggggctgagccggaggcggctcacctggcgggacaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgctgcctgctctggcgaccctgggtgtgggagtggtgccgggctgccttctgcttccgccgctgccgggattgcctccagcgctgtggagcctgtgtgcggggatgcagcccctgcctgtctactgaggactccactgaggggactgctgaagccaactgggccaaggagcacaatggagtgccccccagccctgatcgtgcaccccccagccggcgggatggccagcagctcaagtcaaccatgggcagcagcttcagctaccccgatgttaagctcaaaggcatccctgtgtatccctacccgagggccacctccccagcccctgatgcggactcctgctgcaaggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagcaagccatgactcatccttccagggcaccgacacagactcgtcgggggcacccttgctccaggtgtactgctgacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtac

SEQ ID NO: 800 - DNA, 2699 bp, Homo sapiens
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccaagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccgacccacagcgggaccctcatgatggctttccgggacgtcacggtgcagatcgccaaccagaacatatccgtctcctcctccacggctctgtcggtggccaactgcctgggcgctcacacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttctgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggt

SEQ ID NO: 801 - DNA, 1871 bp, Homo sapiens
tatgtgagcatgtgtacgtgtgtgtatacgtgtgttgtatatatgtgtgtgtctgtacctgtttgtgtatatgtgtgtgatgtgtgctcgtgtgtgtgcatattcaggcaggtgtgcatttgtgcatgccagtgtgtatgtatgtgcgcatatggacacgcatggacacgcatatggacacatatggacacacatatggacacgtgtggatatgtgtgcgtacacgtcgctgggacacatgcctgccactcggggcccagctgccctctgtgtttgtccttgccacagtcacggggtgcatgtgcagaggggagcagaccactggggacgtgctgtgccctgcacgtgcccgggggaagcggaagctgcagctggggtgggggcagcacctctatgcttcatctctgtgggtggcaggagacaaaagcacagggtactatcttggctcctgggagcgactcttgctacccacccccacccatccccttccccttggtgttgacctttgacctgggggttcccagagccctgtagccctcgacccggagcagcctctcggaagccggagtgggcagttgctggcgattctgagaaaacttggccgcatccaccggggccctgcctccagtcggccgctgccgagtctctgcgttctggccgcttcccggcttaatgaatgccagccatttaatcattgctcctgccaccacaaatagatgagcagttaaataaaactcaacttggcataattcaaggcaaataccactctgtgcattttcttaagaggacatgagctgtgtgaatttttagccagcctttggaaaagatgggttacagggtaactcaaccctggctgccatccttgggcactgtgtgtgtccagggcaccttggaggaccgtgcagcccccagaagcttccagctcccgcaccactcagtgaagcccagcctggcgcctgccctgcccccgtcacgggatgggcccccattggggttcaacattccatcgcagccaaaggcagtcggcacttgggacatctgcttccacggacaggtcacctccgctttgcacggaagaatctggatgcttacattaaactggtgttctgagagttcctacggacaggtcacctccgctttgcatggaagaatctggatgcttacattaaactggtgttctgagagttcctacggacaggtcacctccgctttgcacggaagaatctggacgcttacattaaactggtgttctgagaattcctacaggcaggactgaaagcctggtgtgtgccagtatgatgttccacccacagaaacctggtcacaatcgtcccttccagcaccccatccagcagtgactgcacacactgagccccctaccagcccctttcaccctgctgactgtcactgggccctgggatgtgcaagactccacagcagcagaggtggggggacatatcacagcctctgcccccggctgtgatgccaccgaggggctcgcctgctgatggcttcaacagggtctcacctcatcttttcctgctctttggccctggatcgagaaaatttccatcagtgccccattaatatgctgccctgtggcatctgcccaggaggccctgccaggcgtgcacaggtgtgcattggtgtaccctggcatgcacaggtgtgcactgatgtgccctggcatccattggtgtaccctggtgtgcctgccataggaccctgggcgggagctcccatctcatctacatctcctgattcatgcgttgtttcgtaggtttcaatgtctctgtaaatgtggtagaaatgcaggctttatgggcataaagtgtacatttctaaataaatcccttctatttagtatgctc

SEQ ID NO: 802 - DNA, 2569 bp, Homo sapiens
gctctctctcacccagatgggaggcggctgcgggaaaagcctcagtgactggatggtgagacaaggcatggtgagcaggggccaggcccggccacccggaaagctgggggtgctcgcagggctcctgccaggcatgggcgtggggcaccgtgctgctctccaagggagtgggacccaggagaaggcccagaggagcaaggaggggcagctgagggtcttgcgggaccccagggctcaggctgtttccgggttggcccggccagcccagcttccgcagctcctctgtgcccggttcctgctcttgagtctcgggcaaggacaaggtagcccgtctggcagctaagaggcgatggggatagcggagcgggagacggagccggtgtgcacagctgggcacttgctgttgccactgctgctgggaagtcggctcctgccttctctctgggctctgctcctgcctggggggtcctcaggtgctgggtgacagagcttggaaaccaaactggcctggttggggaaagactctgtctgtcttttccaaagtagctcactagtaactagtgctattagtgccattactgattaatagtaaataggaactggcctattggtttcttgagcatctcctccatgccaggccctgtgctaagcttttgacatcccatttcatcctcacagccacctggacggtaagtactgctgctagcctcaccctaaggacgagggaaatcaggcgcagagaagttaagtaacccactcagagtcacactgtgttaaggggtgagctaggtccagctctttctcactctgaagtctgtgcccgcgacctccaactggagtctgcccctgcagaagccgttagagaggaaagcctccaactcctgcccctgtgtgggagccatcgtggcacagcccatgtctttgtggccgaaagtgaaatgtccccatctgtagcaccgcccctctgggtctacccacctggccttgtctggtcaacttcgcgcctctgctctcaggccctgctatgcccccttctatcatgaaatctgcgtctgcagagacaccaggggatggaacctggggacccctggcccactaaccatgtccccatcccagccttcacggctggagaaaatgcctggggtctgaccctgggcttggcgtgtcttttgtcagatgctcctgagcacctgcagcatagcccctgccccaggccattgcccaaagcccctcctccagcctagaatcctacccgaagggtgtgtcggaactggggttcttctcttcaaggggaaggagctccctctgacccctggccctgctccagctgctgggagcctggtcccctgcttagtctcctggctctgcacctccatcacccacagcctggcacagcgggcccagtggtgggtccgggcagctaggcagctgaggctggggtgggaggctgcccagggccacccagctgcagggtgctgagctggcacgtcttccaccttgtcacctagggcactgccttaccctctgcccttccttccagatcccagtcacccaggcctgcctcatggaggacatcgagcagtggctgtccactgacgtggggaatgatgcggaagagcctaagggggtcaccagcgaagaatttgacaaattcctggaagaacgggccaaagccgcggaccgattgcccaacctctccagcccctcagctgagggccccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagc

SEQ ID NO: 803 - DNA, 2583 bp, Homo sapiens
tttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacacgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgacactgcgtgggacgcagagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaag

SEQ ID NO: 804 - DNA, 2408 bp, Homo sapiens
aactctacctttctggcttcaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagaacaaagtacaactgcccagccaggtggagttggaggactccgcagagaggaggcgacactgagcagggtcctgatgaagatttcaccagccagggaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccagggggatggatggcactgtgagtgctccccgggctcctgcaggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgaggtcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggagggaacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 805 - DNA, 2251 bp, Homo sapiens
actccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagcggtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacaggtacaagtcctgcccttgacctctctgcccacacgcctcccctgttccagggaaagtggctctgtgtaggggagtgtgaagggggagccctagggagaaggggctagagtggagagcagttgttctgcctggaggaaaaagaaaaccgtctgcctgctgcatttac

SEQ ID NO: 806 - DNA, 2068 bp, Homo sapiens
agtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaat

SEQ ID NO: 807 - DNA, 2652 bp, Homo sapiens
actgggttgctgatccagctatggagaaagccgcagatctgcaggacacagcctcgttaactctgaagtttaagtttaacccaaagctgggcattgataatcctgtcctctccctggccgaagaccacgacccctatggtaactccctcaccccctggcaaccattccctatccctggaggcaccacggctccacacggcctccgatctccttggtaaccactcactcggtctccctctgataacagccttggttgggagtagagataggaggggccgggtgttttctcctgtcccagtccctctgcccacgaaccccaccacccaacacccaaccaggcagaaactgcccagcaccctatcaggacacagggtctgccaggcacacggcgaacctgtacttgggctgtgccctctcctcccccttttctgctgcccacctcaccctccagatccctggagcctggagcggcctcgcttctgtttactgagcaaagaggagggcaagggttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggtgagtgggagccctgggggcggtgggggaaggtgggccttggggtgggcacacaagcgtatatacacctttcagtgcaccgaagaggtgtccctgtctgagctctggccctgggccgcctcttcccgttcactctggggtcagtcccctggtgtgtacacagtggcctaggatagctggagaggagcagtgaggatgtctatgccccaggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccagggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactgatgccccatggatcttgaatcccttcgatcctttgctgcctgatcggtcttcctctgcttccctcccagagcctaaagccagcaaactttcccccggtgtcccctgttctgcatgcccccacaacaccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccat

SEQ ID NO: 808 - DNA, 3417 bp, Homo sapiens
acacagaccaatggaacagaacagagaacccagaaataacccaaatgcttacagccaactgatcttcaacaaagcaaacaaaaacataaagtggagaaaggacacccttttcaacaaatggtgtggggtaattggctagccacatgtaggagaatgaaactggatcctcatctttcactttatacaaaaatcaacccaagattgattaaggacttaaatctaagacctgaaactataaaaattctaggagataacattagaaaaacccttctagacactggcttaggcaaggacttcatgaccaagagcaaatgcactaaaaacaaatataaattgctgggacttcattaaactgaagagcttttgcatggcaaaagaatagcagcgtaaacagcccacagagtgggaaaaaaatctccacaacctatacatctgacaaaggactaatatccagaatctacaatgaactcaaacaaatcaacaagaaaaaaaaaaatcccatcaaaaagtggactaaggacaattctcaaaagaagacatacaaatggccaacaaatatatgaaaaaatgctcaacatcactaatgatcagggaaatgcaaatcaaaaccacaatgtgataccaccttactcctgcaagaatggccataatcaaaaaatagtagatgttgacatggatgtggtgatcagggaatacttctacactgctggtgggaatgtcaactagtacaatcactatggaaaacaatgtggagattccttaaagaactaaaagtagaactaccagcaattgatccagcaatcccactactggatatctacccagaggaaaagaagtgattttatgaaaaagatacttgcacatgcatgtttatagcagcacaattcgcaactgaaaaaaatgttgaagcaacccaaatgcccatcaaacaacgagtggataaagaaatcgtgatgtatatatatatgaatactgtatagccacaaaaaaggagtgaattaatggcattcgcagcaacctggatgagattgtagactattattctaagtgaagtatcccaggtatggaaagccaaacattgcatgttctcactcataattgggagctaagctatgaggacgcaaaggcataagaataatataatggactttggagactgatagaatttggctgtgtccccacccaaatctcatcttgaattcccatatgttgtgggaaggacccagcgggaggtaactgaatcacggggcaggtctttcctgtactgttctcatgatagtatatctcatgagatttgatggttattatatgggggaagttttcctgcacaagctttcattctctgtttgcctgctgccatccacataagatgtgacttgctcttccttgccttccaccatgattgtgaagcttccccagccatgtaaaactgagttctccattaaacctctttcctttgtaaagcctttcctttgcccagtctttcctttgcccagtcttgggtatgtctttatcagcaatgtaaaaattgactaatacagtagattggtattcagtagagtggggtgcaacttaaaagatacccaaaaatgtggaagcaactttggaactgagtaacaggctgaggttggaacagtttggagggctcagaagagacagaaaattgtgggaaagtttggaacttcctggagatttgttgaatggctttgaccaaaagcctgatagcgatatgaacaataaggtccaggctgaggtggtctcagatggagatgaggaacttgttgggaactggaacaaaggtgactcttacgttttagcaaagagactggtggcatttttcccctgttgtagagatatctggaacttggagcttgagagagatgattcagggtatcttgcagaagaaatttctaagcagcaaagcattcaagatgtgacttgggtgctgttaacggcactcagtttgataagggaaacagagcataaaagttcaaaaaatttgcagcctgacaatgtgatagaaaagaaaaacccactttctgaggagaaattgaagccggctgcataaatttgcataaataacaaggagctgaatattaatcctctagacagtggggaaaatgtctccagggcatgttagaggtcttcacagcagcccctcctatcacagtcctggaagcctgggagaaaacagtttcatgggccaggcccagggtccctgtgttgtgtgcagtctaggggcttggttctctgcatcccagccactccagctgtgactggaaggagccaaggtgcagcttgggctgttacccaagggtggcggccccaagccttggcagcttccacgtggtgttgagcctgtaggtgcacagaagtcaagaattaaagtttggaaacctccacctagattccagaagatgtatggaaatgcctggatgcccaagcaaaagtctgctgcaggggtggggccctcacggagaatctctgctggggcagtgcagaagggaaatgtggggttggagcccccacacagagttcctcctggggcactgcctagtggagcagtgagaagagggtcacaatcctccagactccaaaatggtagatccacagacagcttgcactgtgggcctggaaaagctgccgacactcaatgccatcccatgaaagcagccaggagggaggctgtaccctgcaaagccacaggggctgagctgcccaagaccatgggaatccacctcttgcctcagtgtgatctggatgtgagacatggagtcaaaggagatcattttggagctttaagatttgactgccccactggatttcagatttgcatggggtctgtagccccagcgttttggccaatgtctcctatttagaatggctgtatttatccaatgcctgtagccctactctatctacgaagtaactaacttgcttttgattttgcaggcttataggcagaagggacttgccttgtctcagatgagactttggactgtgggcttttgagttaatgctgaagtaagactttgggggactgttgggaaggcatgattggttttgaaatgtgaggacatgagatttgggaggggccaggggtggaatgatatggtctgcctgtgtccccacccaaatctcatcttgtattcccatgtgttgtgggagggacttggtgggcagtaactgcatcatgggggcaggtctttcctgtgttgttctcataatagtaagtctcacaaaatctgatggttagtataagggagagttttcctgcacaagctctcactctgtcgttgcctgctgccatccgcataagatgtgacttgctccttcttgccttctgccatgattgtgaggcttccccagccacgtggaactgtgaattctccattaaacctctttcctttgtatgtt

SEQ ID NO: 809 - DNA, 1990 bp, Homo sapiens
acttctcagcccccctggcctgctccatcccgtcaactctcccaggaactaccagcacccacctaagggacaccagccgccctgtgaaaggacaagccagagacccctggagctcggatgtggaaggatgtggggagctgcctggtcctgtctcccactgccgcagagggacatgagggatggagcaggactggcaacctggagaggaagtcactcctggtcctgagccctgttcaaagggccaggctcccctctaccccattgtccatgtgacagagctcaaacacacagaccccaactttccctccaactccaatgctgtcggcacctcaagtggctggaacaggattggcacgggctgcagccatacctgggactggaggttctcctgcacccagcaggcccttttgcccctactaggagcctgggaatggagcattgacacagaagcaggaggaggaaggagagagcagagccagaaaccctgcagcaacggagggcctgcagcagctggagagggccgagtcctcccaagcccctgctttccatggagcacttgccaggcagccattcacaaagtgtgtcgttggcagggatgcaccagaccagctctcctggcaccatccctggccacactcaaggaacacagttatccctgatgctcttggcctctctccctgagcagtactcaccagggcccacctgactcacgatagcccctgcccaacaggtacaagtggagctggtgctggccccgggctgcctcccacccaggtgcctggcctgtggctccaaggtggactcccaggcccagcaccaccagtgacagcaacagacccctctgcccaggccggcctcacacggggctaaagacacccacggctcctgccagcagggtccacacaggccacctcgctgcccgtcctctccctcagcccctccttaagcactcctgcaggctctcccagctgctgccagcacatcccgggtgaggcttgcccggacccacaggtaacctgggcccctgccaagccagaatccactctcagctgtgcctttctcggccctgagcaaagcagatcagtggagtcagaggcacctttggggcagacaggggaagaggagtgcattcattggagaaaggttgggagctacccagccgtaggctggcaaatcagctcctggccgggggcaccctgacttacaggctttgcctgatttctgtggtgtaaattctccccttgtgcccagtttcaagctactaatgtgtcgtggaccgtaactggggagcaacacagagtcagctggccacgatgccagtcactgctgagctgccaaaccttacgcgtcccagggggcacctgcctagaggccaggcactgcactggaccctcagacacagcttgtgcagcctgcttaggagcttgggaaatgactgtcatctgtgatcttgctggtcccaggaagcccattttacagatgaggaaactgaggcccaaaggcacgaagcgacctctctcagcctcaccaagagcactggaaggtggtgtagggctgcggccgtgcgcacagagagcacagcagcaggaaggctcctgggcctccagctcccctccctcagaagcctcccagagtgacaggaaggtcagaggccccagggagggggcggggccaggatctggcaatttcctatccctctctgttggctctgtgcatctaattactccttgagtcatctgttgctaaccaggaggggaaattaaatattaataatgtaatacttctctgtgattaccccttgttggggacagatcagagggcagatgctgccccatacagacaggggacacatgctgcggaatgtgcataatgcctcttgaaagaaccaccttataggattccacgcggtcagactcaaaactgctgctgcttcctgccttcctcctcacctcccccaacctggccactttaattaaaactccatttaatc

SEQ ID NO: 810 - DNA, 3426 bp, Homo sapiens
ttctcttggctgtattctaccatgagctccagagcccccacgtcttcttaggggaaagttttattccacccactctggttcagtcagcttccttattgctgaatgaatctattggtgccaactatttcaacatcatggataacctcttgtatgttgtcctacaaggagaggagcccattgaaatacgctcaggtgtttccattcacttggccctcactgtgatggtttcagtcttagaaaaaggctgggaaatagtaatactcgaaagactaactaacttcttacagattggccaaaaccaaatcaggtttattcacgagatgcctggccatgaagagaccttaaaggccattgctgacagtagagcaaaaagaaagcgcaattgccctactgtgacttgcactagtcattatagaagagttggtcaacgtaggcctctcatgatggaaatgaactcacatagggcttcacccccaatgactgtggaaactatctcaaaagtgattgtcattgaaattggtgattcgccaacagtaaggagcactggaatgatttcatccttatcaagtaacaaattacagaatttggctcatcgagtcatcactgctcaacagactggggtactagagaatgttctgaatatgactatcggggccttactagttactcagtcaaagggagtcattggctatggaaatacaagcagttttaaaactgggaacttgatatatattcggccctatgcactttccatcctagtccagccttcagatggagaagtgggaaatgagcttccagtgcagccacaattggtatttttggatgagcagaatcgaagagtagagtccctgggacctccttcagagccatggacaatttcagcttccctggaaggagcatcagactcagtgctaaaagggtgcacccaggcagaaactcaagatggttatgttagcttctacaacttggcagtcttgatctctgggtcaaactggcactttatttttactgtcacttctcctccaggagtcaattttacagctcgatccaagccatttgctgtcttgcctgtgactaggaaggagaagtcgaccatcatcctggctgcttccctgtcctctgtggcctcatggctggctctgagctgtctggtgtgctgttggcttaaaagaagcaaaagcagaaaaacaaaacctgaagagattcctgaatcccagactaataatcaaaatattcatatccacatctcatccaaacgccgagaatcacaagggcccaaaaaagaagacactttggtgggagaagatatgagaatgaaggtcatgctgggcaaggtgaaccagtgcccccaccagttgatgaatggagtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccaagagaagaaagcctcctgcggggccactgaggcattctgccttcattcagtacacccggaaactattcaggagcaactgtgatcagggaagttgggggcatttggcctgaaaggcagaatgttcccagtatttctggataataagctggggaagtgaggactgtcctgctgggacaactaagaagagagaatgtggactctgaatccctttttcaactttaaaatggaaaacagtcatataaatgcttacagactgaaaaatgtctcatacatattttgcagctatcatgatcctagttcaatgctaggcaaataatggcacttgttaattatttaccagtttttaacttaagcctgattttaacaacttgataatggtgtaatactgacttataccagcaggggttattattaagcattctctggattgaccacccacaatgctttgagcttctcttatagaagggatcatgaaaaggtctggtcagctacagtttaattccacactgttacagaaaagcatttctttatcctgtagtagcatttgaagggacagttcaacaccctgctccctgatctgtcagagcttaccttccaaccacaaggcaacttcctggctttttacaagtggattttatttcatggtttaaattcaatcattattgagaacctacagtagtgtgagcgtatcaaatttgcacttcatgaggatttacacatgaaaattgatattctcatgggctttgctgagagtttagttaaggacaaagatgtaaaaatgccaaatttgggaaaggaaattttgtatgaccactgttctatttttcagtgattctctctgttagtagctgggtcacatttacaactggaaaagaactacattgggagatcagagaaagccaagtggccaagtcctttatcaaaaagctgctttttggagaagatgatgcataaagctgtgatactaaggagaggagagattatgtcatatgcaactgctctaggctgtgcagggggtttaaatggagatcagaacaaaggctcacctggtattgatacatttggtaaggttgttaaaggcaatttcaccaaattcacacatttgtacggggcccatttcttttcaaactgaagaatactttaaacagcctgactgtgtccttggctctggatccagaaggccttatgctccaagcatgtaaagaaaagatcgcaggaatgtggagagcttccaaaaagagattgctctcagattttcctgaaaatcctgaaaaccaggattttccaatctctacaatgttaaggggttgttgtgtagttgcattggaagagagaaaggaaacacactctttcattgctgaattctaaataatgatgccctgaattagttctatgagaagtactggcagacagctgttatgtctgcagggcatcaaggggcaggtgtgtctcaccctactaagaattggcagaaatgttttaacctcttctttaggcatctggtgagtattgcagatcttcaggctgtccctaaaaggaggtaggtagccttctctgtggtcactgtgttggatttggaagaaaatataagtagatgttaaggtcagtgctctccaggagatttcaatccaggctatctgtgttcagggaatgatttgcaagaagttggtttatagacgtttactctggaggcacaagctggctgccatgctgagtaagtcctctttgtagatgatgtattttgcttgggcaccaacagaatt

SEQ ID NO: 811 - DNA, 1842 bp, Homo sapiens
tattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtacaagtcggcggtggtggcagccagtgtcatcctgcactctcagcccctgagccccgcacagcggctggtgggctggatcgaccacatcctccagactgggggagcgacgcacctcaagccctatgccttccagcagccttggcatgagcagtacctcattgatgtctttgtgtttctgctggggctcactctgggcactatgtggctttgtgggaagctgctgggtgtggtggccaggtggctgcgtggggccaggaaggtgaagaagacatgaggctaggtgtagccttgggtgaggggagggcatccctggtcctttgaaggttctccccaccccagcacacgccacccctctgttctctcttcagctccacctgccactgatcctgcaacttgcttctttctattctctgcctctgtttagaaatcttcacgcaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctccttctatcacttttcataaaaaaactcaggaaatatttgacatatcttccatttcaaattcttccattttatgcagatatcttgcccttcctataagctctcctcaaagctcaggaaacctggtctgctctcctgcatttagggaaggagaacccctgccaagacctttgctcactgcctgagaccccttccttagagagcacctcctttgctggtcagacatggagcctgcagttggtcacagatgatactgctttatttcagtttttacagttgccttcttaagattcccgtcttataaatggagtacagggaacctcaagtagtgaagtggaaatccatgtgtaaggctttgtggcttcaggtaccagtggctaaggtagttttaaagactttgttgattttagaaaaagtccatcttccatcccctacatggcagttaatacccttctatatggtaaaaccttagagattaccttaatctgctaggaacagaagcaagaaaaaccatggcgtaaacacccccagagtttttgttcatttgtttcatctttcttgataaagcccgaaggtagcccattcagggctgttgtggttggttgctccatcatgtcatcaatagcccatatcttttcttttttatcttccttagtataacaccaaactacctctctgatagctggtgttcatgaaatattttaccttcaaatgattgtacctttttatttgctttagagttctgaaataaaatgaaattccactgt

SEQ ID NO: 812 - DNA, 1958 bp, Homo sapiens
aaaggcagggatgaggtaagtgtacgcttccaaaagcttgtgagttggggaatccatgaagagagactggggaggtggttttgttgaaagaacaaccagcacctcaattcctggggcttctgggacaccagatctatggtccaggagatggagagaggtgagcactatgaggatttcacctacaacccagagatggaggatgaatgttcctagcaatttcaagtaagtaggagaagaaagcaaaggttctctgagagcccatgactcttcttaagaagacttagtaataataacaacaatagtaataataatattgatcattcatcaagcacttgccaagagtcaggtgctgagcaactgacaaagcaaacgcacatattaatcctacttaaggttcacaattaccctttggttcaggcactattattttttccattttccaaaggagcaaattaagactcagagatattaaatgacagagccgggttctaacacaggccaagctgcatgcaacacctatgctttcagtttctatactccatcaatttgcttgtcttggcttctggaccttcacaaagccactctctcagtctgtacttgttagggtcctccagagaaatagaaccaatatatacatatatgtactccgcaacttaggatggggttacatcccgataaatgtatcacaatgtcaaaaaaattgtaagttgaaccattataagtcaagaatcctctgtacacacacacacacacacacacatacagagaatgagagagagagcgagagagagacagagagagagagagagagagagagagattggctcaaagaattatgtagtttgagaattcccaagatctacagcttggaagctgaagacccaggaaagccaatgtgtatatccagtcttagtctgaagacctgagaaccagaagaaccaatggtgtaagtcccagtctgagggcagcagaagaccaatgttccagctcaagaagtcaggcaggaggatttcccttttactcagcctttctgttctacctaggtctctaattgcttggatgagcaccccacccccacactagggagggcaatattctttatacagtctgattcaaatattaatctcatccagaaatatagacatacccagaataatgtttggccaagagtctgagatccccgtggcccagtcaacttgacacataaagttaaccatcacacagtcgtcttacaaaatatacactggaaggcagatatactgtgatatgctccccctatagttcactgaaatacagcagatatttgttgcccatagcagagaaatgcaatctgctaatcaaatacaaaactttgtttttctcaatctgaatttatcagtgtttgagggagtctcatttaactgaaagcttccaagaatttaaaataaggcagattgctcattctgacacttggattcatgtttagttttctctgtccactgcatgcttgcataggcagcaagaggtctcaccatcactcttcgtgctggatgatgatctgctgataaggcctcacatttcatccccattttcccagtgtcaatagcccctcaatctcccaaccttaagagatgtgaaaaagaattatactttatagatgcctctgtggacagcaaggaagaaaggggtatacccagctgggagatcttggtgctgccttagaaacacctgatgtggcttcatgaggtgacttctgttttggaggtgaagtggaagacagcagcagtggaaaatgatgatgggtagagatatgtagggccaatgagttggagacattttagagtatgccataactgagaaactatggatatagagggaaactaaccaatttttaaaggaagatttccaattaaaatcagtgtgaacacccaacccattaccatgttgtctaaataaacttcactggtttctgttttagc

SEQ ID NO: 813 - DNA, 2484 bp, Homo sapiens
ggatgccagctgagtgctggccgtgggcccctggtcctggcacgagaggagcctctgttcccaaagctggggtagatgtgttgctggactcacgtgcacacacacacgtgcatgggccgagggcagggcccgcagtcccctggtgtgggtagaacaccctgaccgtctctggcgtggagagggccttccatcccccagggtgtgcctcagggccccgaagcccaggctggccctccccactcttcctgtactcctggctcatgcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtctgcagagcggggcccaccccgcccgccgaggcagctgagctgtcctgcgagtggattggtttgaggtcaaggtgctgctgctactgccttctgccctgtgcacccacctacccacccacgatcccagtggagcctctttcctgactcccagcatcctcccacagccccaccccaactgctggctgcactgggcaggccttgcgtatggctggaggctgaggcagggttcgctggaggaaggggtggggcggggccgagggtcacccctgcttggtggagcctgctgtccctacccgacgtggtgcactggtggtgtttgacccaagcatgcggctcgccatcatgccccgctacagtgcaggagcgcagctgctgccaggcttagagcaggggctggtgaggaggccaggactctgcccaggagggcggaacctgaagctttgggtctgacaaactcaagcaggcagcagggagggactgcagtggccttgcttgcgctctgactggtccttgcctgtctgtgtggtccagcctgggccgcagcaggtcctggtggggaggtttactctgttttggggtctgtcaggcactgcttttccaccacctgtaagggggtttcccacctaatcagctgcagactgctcccgggttgcagccactggcctgggagcaccaggccgccttccccgcatgtgccctgggctggtgggggccttgtggtccctggagctcagcagctgttgatgtttcaatgaagggctactgggtgggggcaccagcctcgacgctgcccagccctgcagcactgagccctctcccagagggaccctgggactgccacagggtgctgagtgctgctttgttctgttcttgcttctaaaaccaattcactcaccaagacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgaggacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcctccccacactgagctcctttgttcctccccctccagcctttgcctgggaactggtccttgtttgccggacttctcggagggttcactgtacattcgttctcaggtggtcttgtggctgtctttcggaaaatggttattttatatgatttgtcatggaatttgttctaataaatcattcttctatc

SEQ ID NO: 814 - DNA, 1723 bp, Homo sapiens
attcagtcacagtcacagccaccatgccagggaggacctgggagctgtgcctgctactgctgctggggctgggactggggtcccaggaggccctacccccaccctgtgagagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaaggtatcagcgtcctgggcctgcccaaggcctgaccaagggaactgaagagaggaatgtgcctggggcccacagtgtcttcggagcacagatcagggactcctactgggtcatggagggtctgctcctctcaaagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctccccacctggccccagctcctgccccattaaacctctgcaccagt

SEQ ID NO: 815 - DNA, 2219 bp, Homo sapiens
agagtttggcttcttccctcactttggctgcctcggctccctacaagggcccttcctagatgccagaatttgtgagttgcgaagtcattgattccaaccctctgctgatgtgccaggtgccaggatggtatctgcactcacttccagtccagcacctgcacgttgcttcttgtgatgggagctcattgactccagaaaatgtgggaggctgaacgataagaaatgaggtcagatcatgtatgttccctccctgaagagagaggtggtagggtctggggaggatctcagtgaagttggtctggacaatgggtttatgggaagagagaactggacaagaaaaagaccctgtggggcctggaatgccaggctgaggggctggaaccttgtcccaggggtactggggagccatgaaaggattgtgagcaggagggtctgggtcagctctgggtataggaagacctttctgaggccatgtaggagacaacctggaggggagagactggaggtcagggtagaggctggcatgagggatttaggagaaaagaacaaggcctaaacagagagcagaggatggggcagagagagtcagggggcagtagggatggggcagtagtgggctgttggagagggagggagtgatgacggtacctggagatataacccagtccccctgcttccatcaagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcggtatggtcatcccacgtacaggcctgacgggtggggagcaccctaactccataaaccccagggacgcgaggccgtgccaggggcaacaacagggggaaatgggatccacgggggtgtggggctgtgggagcagcggctgtgttgcgggagagccaaatccaggtaacttctttcttcccacacccatttctccctgtcatctctgtgccctcctttcccaccgtgcaccaccacctttctctcctttcctcctctctgtgtgtccttcatctctctctgccccccattgcttctgcccgtctccctccatttctcttgatctcatccctctcttcccccttattttgttctctctcttcctatctctctctctctccccctcatctctctctctcctccccctttctcctcccctcccctcccctcatttcatctctgtatcctggtctctcctccccacagacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgg

SEQ ID NO: 816 - DNA, 2634 bp, Homo sapiens
acttccgttctttgttctgtccccggtgtgtgggtctgtgacagggtccaacagggcctggtccgtgtccggtcccccaaatctgtcgtccctgcccccaggctcttccttcaaaagttcctgccttttccgacaaggacagcctgggggatgagatgttggcggctgcgctcctaaaggccaagtcccaggtgagctgtggttccgtttatccttttcctttccattttctgtgcaatgacatcccattcagagctttaaaccctgatctcctccatcaggcccatggttctgtcctgctgaatcgtggaccctcaccttctatcttggactcctgtctctcttcctccaccctgtcctcccttcctcccttcccaaatgtgcatttttcaccccatcctcagtgatttttttggtgccgccattcacattcctcaccctgaaattgcatgccagcacgtgttgtttcaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactgaggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagcccaacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggag

SEQ ID NO: 817 - DNA, 2722 bp, Homo sapiens
atctgtgtgatgcatgtgtgtgcaaccgtgttcatgtatgtgatgcatgtacccatgtgtggatctgtttcatgaatgtgatgcatgtgtgtccacgtgtgcacccgtgttcgtgtgtgatgcgtgtgtgtgcacacacatctctgtgtgtattcctagcactcatagctgccctggatccatatccagctctcgtgccacttcctgtgtgaccttgagcagccagcagccccgtgggttagccccctggggagacatggccaggttgggcaggacgtgggtgtagggcttgtgatgccaaccctgtgccagtcgggaggcccagggcatggggatggccgggctacccagcgagctgttggctgtgctgggacagaccccaggctcccagtggccctgctctgaagcgtggctctgtctccccacctgggggcagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccaggtcagccccagagacaccgctgctgtttggggtgtacgtgaagggagccttcctctgaggaggcaatgcctgctggggctttggaggatgcattcacaggacctagaatggagggaaagcctggaggaaggacccagccccgtgccccaggcccgccctcatgaatagagaccctagctgtttcagagtaccttgttacagactcatggtgatgatggaatgtctgcttctggcagcttgagggactggggtggctggggtgttgctgacctggaggagggcagggtgcagggtggggctgggcctggaggccactcaggtgtctgtggggctgggtcagggcagtccagtgggcgtgtggggcattagggaggcagggctggggccagctgtgctgtgctgaggtcaggctccttccaagctgtgtcctggtcacgttgggcctggtggcccaggtcccagaggctcaccctgctccttctccagggagacccttgtccccggccaatgtccctgctctgcctggcgagacggtgacctccccagtcagggtgagtagtggtggggagccgggcaggggcccagccctccggcatcctcaccgcccctccgttcccagctgcaccccgactacctctccccggaggagatacagaggcagctgcaggacatcgagaggcggctggacgccctggagctccgcggcgtggagctggagaagcgactgcgggcggccgagggaggtgagcgcctcggcctggccctgggccagcccgactcccacagacaccctcagtcctggggctgggggccatgaactctggcgggcccccctgccccagctggctcctctccccagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccggtgcgtcccccgcgcgccagccaaggggccccagccagggatgccgcggagcccaggatgtctgggggccggctctgtgaggccacctgactgtcctggtggtgagaccttccctggagccaggcgagcccacgtttgagtttcaaatctcccacctcctggctgtgtgtcctcagccaaggtacttaaccttgctgtgcttgggtttcatcctctgcaaagtgaggatgcttgtagcacccacctcacgcagctgttgtgaggattaaacgaatcaattcgcacaaggcatttagtgtagcagcagtcagggcgagccataggcatttgtctcgtgatgcagggtgccctggctgagggcacaggcccaggccgtctgcctctgccctttccttgctgtgctgcagggacagcgacgccctgagcctcagtgtccatatctctgcagcgagtggtgtttctgcgagatgatggggaaggatcccagcacacgggctctgacgtggccgttccttccttcattcacttattcactcattcattctgctccggatccccccaagaccccaccttcttcctccaaaagaggagcctggcgcttgggtggtggggacattgtgtcctgtgaggggcatggcagtggtggggggggctcctgctgacgagccatccccacagaggctctgaagtcactgcaggagcggcggcgggagcaggagctgctggagcagtacgtgagcaccgtgaacgaccgcagtgacatcgtggactcgctggacgaggaccggctccggtgtttccccccgggccggcctgccgtgacgatcacagccctgccgtctcaggtcacggttttggattctgcgctaacgaggtctcccaggtgggctggaaacactgatgaagacggatagaaaaaacaccagcccaccggattattaataaagataatcacacacaccccttcgtcggcagccggcctgacactttataaagcacgttaggatataatccaattgaaactgcaatatcgagaacatctcatcttatcacaaattgaaattatatcacattcctcttttcttaaattaaaaagctaaaacctt

SEQ ID NO: 818 - DNA, 2116 bp, Homo sapiens
attaacgagtgacagtcttaatgactaacacacctctaacatttcacctctagctcagatgagagagagaatgggacttcttggtactgattgtttttcccatgcctcaattggtttcttttagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagagacccttccagaagagcagctcacgtcctgtggggccagtgactgcctgatggccaccacaaccaccaacagcacccagaggccctcccagcagctggtctacaccctcctgggcatctacactgggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactctttatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgtttctaaataaagacggttatttaatggacttac

SEQ ID NO: 819 - DNA, 2547 bp, Homo sapiens
atatgaacacttgctgtttgcctggcatgcaactcaatgactcaccaatttctcactacaacttctggggataagtgattattatttccattctacatctgagagctctaagactcaggcaggtgatgtcatcagcaggcagcaggcaacaggcagggctgccaggaacccttgcataggttgtgcactgcacaaggacaccacatctcagggttaccactctctctgtagacctgtgtatttattattatgattttctgccaggtggaagtcaaatgtctcaagataggagtgtctctctctctctctctctctttcttctctctctctctttctttttttgagacagagtcttgctctgtcacccaggctggagtgcaatggcgcaatctcggctccctgcaaactctgcctcctgggttcaggcgattctcctgcctcagcctcctgagtagctgggattacaggcacctgccatctgtaatcccagtgctttgggaggctgaggcaggaggattgcttgagcccgggaggtcgaggctgcagtgagccatgttcctgccactgcactctggcctgggtgacactgcaggcttagaaatgaaaacaagctgtgttaaaacatacatgttatgaaactttggacacgtgacttggcctcattttccccctctctaaaatgggataatatagaccctacctctctgggctgatgaaacattaaagaaaatggtgcaggaaggcgcctagtatgcgatgagctcttggtacgtggcgacttccgttgtggcttttttgtttgcttgtttgtttttgagacagagtcttgctctgtcgcccaggctggagtgcaatgacatgatctcggctcactgcaacctccacctcctgggttcaagtgattcttctgcctcagtctcccgagtagctgggattacaggtgcgtgccaccatgcccggctaatttttgtatttttagtagagatgaggtttcgccacgttggccaggctggtctcaaactcctgacatcaagtgatcctcctgcctcggcctcccaaggtgctgggattacaggcatgagccactgtgcccagcctattgtggttctttttttaaagaacagagagggcagggtgtgttaggggccatggtagcagctggacagaggtttgtaccaggtggggcaggccagcgggggctggaccagcattgtctctctcacagaatacatccagcctgtgtgcctcccagctgccggccaggccctggtggatggcaagatctgtaccgtgacgggctggggcaacacgcagtactatggtgagtcctgtcctctgcctctgatgccaccgtttgggagactctgaactgggctggggatgggcagtctggctggttggatgagtcttgaccatgaggagtagggacgctgaggggaatggggtgggcaccaggagggaaggggggtgtgtacaccccccagctctggccagccttgcctgcacacccccaggccaacaggccggggtactccaggaggctcgagtccccataatcagcaatgatgtctgcaatggcgctgacttctatggaaaccagatcaagcccaagatgttctgtgctggctaccccgagggtggcattgatgcctgccaggtgagggactctgtaggggcagccccctggtcgctgccaccccagggatggagatgcaggggagtgggtggtcgggctccccatctaaaagcctgagggctctggggccacagcccatgtcatcccggggtgggcctcctgtccaaccactttggcctccagccagacctccctctcccctcccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 820 - DNA, 1688 bp, Homo sapiens
ctttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagtttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgagggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcctccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtg

SEQ ID NO: 821 - DNA, 2324 bp, Homo sapiens
attcatggctggaatgatggtgggaggcaacctatatggccatttgtcagacaggaaaccattatcatcgcccaaccatgtctccactgattgtgacgagggacttgaggtgcccattgccatccaccagcatcacgtcttctggtatctctcctgaaaccctgaatgaaaatggcctccatctgcatccatgttgctgcagaagacatgatttcattcttttttgtggctacatagtattccagtctaccattggtgggcattgaggttattccatgcctttgctactgtgaatagtgcttcaatgaacatgtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaggcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttacaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctgtatgaagtgtctgttgacccctgctgggaagtgtctcccagtcaggaggcacaggtgttagtgacccacttaaggaggcagtctatcccttagcagagctcaagcactgtgctgagagatccactgctctcttcagagctggcaagcaagaatgtttaagtccactgaagctgcacccacagccaccccttccccaaagtgctctgtcccaggtgatgggagttttatctataagcccttgactggggctgctgcctttctctcagagatgccctgcccagtgaggaggaatctagagaggcagtctggccacagttgctttgcagcactgcagtaagttccacacagtttgaacttcccaatggcttccttaacactgtgaggggaaaactgcctacacaagcctcagtaatggtggacattcctctcccaccaaggttgatcatcccagttcgacctcagactgatgtgctggcagtgagaatttcaagccagtggttcttagcttgctgggctccatgggagtgggacctgctgagcgagaccacttggctttctggcatcagccccttctccaggagagtgaatggttctgtctccccctggtagcattggcacacaagggaatctcctggtctgcgtgttgcaaaaactatgggaaaagcataatttctgggctggatagcacagtccctatggcttccttgggtaggtgaggaagttccctggccctttggacttcctgggtgaggtgatgccccaccctgcttcagcttaccctccgtgggctgcacccacccactgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatgggaattttggcttcttagatctttactgtgagtttgactgatatcagtacatttttatttttaattgtatattttcattactgtgaatttttttgcagtgatttttgatgccatgtggctacattggttttagaatactaataaaatccattgctttt

SEQ ID NO: 822 - DNA, 2246 bp, Homo sapiens
ctggtgcccaaaaagggtcagccactctgccagtttaggggagaaaacttctcacctgtccaaagcatagccttgctcctgcccggcctacccagctatgacactgtccctgagcagagatgagcacaggactttgggccctggatgccggagagtgggtgtttgtgtgattcccctgcagtctggaacaggccccaaaggcaacagcatgaaggctgtccagaggttctccatcaccctcagccgagtggggtgctgagcagtgagggaggggacctgggaggggggcccagcctggatcctgcaggggagaagagaagacagccagaagccagcagctgtggctcagatctgagcccgagcagcctctcgaggtggaggcagacaccccccaccccaccccgtgcagaaagaagccttgccagcctgccctgaggctggtacagagtccaggcaggctcagtggccatcatgcccctacgatgactgtcactccctctccgtgcgcctggcctctgctggctctggccaggggtggtcacagcactagggtggcagggtggcctctgactctgcgccagcctgcactggcctgtgctgccctggcctctgctggctctggctctggcaccggtcccgtgttggctccttcagccttcacatacctgctgcggccaccacaggcccaggacccccacagggtggccaccccacctccaccccaggagccccaggtatccagctgtcaccccctccctccctcctggcctccccctgtccttctccagttgccttcttttcctgcgggcgcaccacccacctgcctgcctcacctgttccgcctcagcccccagggtccccgacatcctgagctcagtgaggaggggctcgggagccccagaagccgaggggcccctgccctgcccatctccggctccctttagccccctgccagccccatgtaagtagcctgggtcctgctgctgtgggggtcatgttggagggctggcaaccccctagaggggccactccagagccgagggcaggctgagcgtggaccctggctccagcctcatcaccccacaatccctcactggggctttccagggtggccccagcccatcgagccccacctctttgtgaggagggccctggaccactttcctgctcaaggccactgggcaggatgggaggccctggaggctcgggcctcaattccagtcttcagggtcggtgcaggcctcactccacctcagcttgcgggcgggggggctccctgctattgaggcaggctctgattcagggcctgatcccagggcccaaggggtctagaacacgggacccctcccactggcctcctccgccttgccgccgcctcgtgtgtctgtctgcctcatgttcacgtctcatctgttccaccccagcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgagggcccctcgccagtggggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgagttgttaaaaaaaaac

SEQ ID NO: 823 - DNA, 2317 bp, Homo sapiens
tattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcaggtgagccgagcacacgtggagtggactccccccccagctcggagacagtcattctgacaggactgaaaacagcaaaatgcaggccagagaataagcagaaccttgttgagtgaggctgctgtgtgccttacggttcgggttgagagtgaacccagaggacgagggatcccagtgctggtctgggcccggcccacagtggatgtgggcttcctcgtcaagctcgagtcctctccactccttctctctgggtctggacaagtcgtgaacccgcagcacctcggcttcctgctgtgtgaactgggagattggaaggggccagcctggcacggcccctgaacatgggagccctcaaacgtgaccctgcctgtcctgcccaggggcagcacttccccgaacgccatcgactacagtgacagcgccatgctccaagctcagcagctgctcctggggctgggctctttcctggaggacgcacgtgcctacatgaaggggcagctggcctgcggctccgtcagggaagcgatgctgtgggagaggtaagaggcccgcctagcacccggcgtggcacccctcctgtggcctgctgggtgctgctggtgggctcttgaaggggaagaggggcccccaggagacagggcgctggacaggaggtttggggtcagggactgcccagagaggccccaggagacagggtgctgggcaggaggtgcaggtgtggggtcaggggctccccagaggccacaggggactgggagctggacaggaggtgtggggtcaggggctccccagaggccacaggacactgggtgctggacaggaggtgtggggtcaggggctcccgagacatcccagggagacggcgctggcaggaagtgtgcctggggccctcgggctctgagccccctgctcagagtggctttgggctcgggttccctgtgcgaggagcggagctgctcatccctcccagtcctgactgtgaggagccaaaatctataaaacacacaggcctgggcccacagcatcgcctccactccccacccacgggtgtcctgggcagcgctgcacattcatcccggcatgcagagtcttccggatggtcttggtgataacccacccctgccacttcagcagggtaggcagccagtggccacgggaggctgagatccgggagccccgggctgggcctccccagcctctctttgtgagtggtcagccgtgccgtctgtcccccaccgagtcttccttgccactcccctcaatatctattgatttttaaaaccatcatgaaaatgcccacgcgtgtcttgtattttaagtgtcacaggtgacctctgctctgggactttttcttggggtaacatgacagtttgcagttgatgttacataattttctgctactcaggaactcaagtctttgggaatatgacctagagaaagtccccagattagagcccccagcgtctctccctggggaaggactggtgtgggggccgcctggggagagtggagctccctctgctgtgactgttctctcctcttccctcaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaacc

SEQ ID NO: 824 - DNA, 2412 bp, Homo sapiens
gttaagtgccggttatgggccaggcactgatctggactagaagctgggacctagagatattgggggacacctggcaagggctaagtcctggtctctggtggggctggtttctggtggggctggtctctggtggggttggtctgtctctggtgggtttggtctgtctctggtggggttggtctcgtctggtggggtttggtctctggtggggctggtctctggtgtggttggtctctggtggggttggtctgtctctggtggggttggtctgtctctggtggggttggtctctggtggggtttggtctctggtggggttggtctgtctcggggctggtctctggtggggttgggctctggtggggttgggctctgctggggctggtctctggtgcggttggtctgtctctagtgcggttggtctgtctttggtggggtttggtctctggtggggttggtctctagtggggttggtctctggtggggttgggctctggtggggttggtctctggtagggctggtctctggtggggttggtctgtctctggtggggttggtctctgatggggtttggtctctggtggggctggtctctggtggggttggtctctggtggggttgatctctggaggagttggtctctggtggggctcagtcggtctgtgcaggagtcaagtgttagaggccacactactgaaggctggtgttggacttagggtcaagagtccatctggggctggggtcaggtcacagctggagtcaggcagcccagtcaagaggctgtggaaagtcaagctggagaggcaaggccaaaacggaactggttttggggtcacctgggcctgatcactcctacagaggagggcttgaaggactcgacccagatgtcggccacctattcccagggctttacgctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaggcttgcagtgactttctgacccatccacctgtttttttgcagattgtcatgaataaaacggtgctgtcacctc

SEQ ID NO: 825 - DNA, 2512 bp, Homo sapiens
aaggacgcgctggctaaaggtacatcagataatggtctccgtggccaagtcccattcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcaggtaaggcagagcccttgctgctgctgctcccccaggagtgcggggcccggcgctcacccctctgctgcctttcttcactctttaagtgccagtctgggcacttcgggctccctctttagtggatcgggtggagagaggagagggagaagggctgtgctgggaaacatggagcgacagtgaatggcccctccccctgcccagggaagggcctgggcataaacaaagtggcagcagtgccctgccaacccagtgtctacggcctgccctctgtggatgggaatgggggtactgcgaatgcaaggagtcttgaaacctggtgaaagaatgcagggacagccacctcgcagccaaacggacaggacattcagagcaactccagcacaggccccctccctacgtggcagacagcctcagtcgctatctgccaggttctacagaggagggcgcagagactgaaacacgttaggagcctgtccggagactactggggtggggcacaggtaggatcaatgctggggacctgggtgtggccccttccagggccccaagctgcctttgccttcctggggtttcctttaaagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctagagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacct

SEQ ID NO: 826 - DNA, 2637 bp, Homo sapiens
gacattttggcaataaagacaattatcagtggtgctgatgtataaactggaagaaggaccgtatgttgttcattgattcttctaggagtttcaatgaaaggatttttctgtgttgtattgtgggaagtcttaaaagattttcagtggaatttcccctctcttttcagttaacaaataagaagatcatcatgaaatggagatgtgggaactggccagaaggtatgttactaattactgcccttcatattaaaggtcccaaaacactaaggctaggtttttcgtatggataaattttccttttcataatgcggtaataaggttcctattttttttcttagaacactatgccatggttgcactgaattttgtgcctactctagggcgaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactattcctttattttactttagggtttttaaggtgtgtagatcttaggtcgtaaaacagtggtatattgcattcaaaagcatgttgaggtgagggcaaattggctgtgttttgctccacatctccctgcacatctccctgctgtggttttgcacttcggtgtggagaggattgagaagtctgtggggacagattagttctgtggactgctggtaacacttccagtgaaacagcatataatgggtaaatgtttcccccctctttcacggttttctcactactttcacctgagaagactgaagcaacgtatgtaaacaaatgaaaagtcatcacaatcagtttaattaagtgcacagaatagcaatcaatcagtcatgtcaataaaaataaaacaattatttttacatcaagtgtgctttatttcctccacaggtattctgttaaataaagcaccatctatatactgccaggccacagctaaagaggattctttacagaatcaaatttcttgtggttgttccgtatacaagtaaacttaattttgataataagaaccacagcgatcggaggcaatctgcctctataaggtacaaaactggcacagaggacaccatatcatacacagtaaaaatgctgtaagtttaaattacattgtacagggctaggcaaccctgttcttcccagacagccatattaaatgaaagccactaaagtgaactcttaattacataaaacatatccattatctgattgccctttaggaagtatactgaagatgcaagtttttttcatctggagttctgcctgaccaagaattaagcctataaatctatcttgccattcaagcagagagcactggacaaactgaagcacaaaaacaaataagcaaaacttatacaaacagcatgggggttgggggtgagggacttaaaagtagacatgctacacctaatgtcaagaagcagcttggtttcctttgccagatatccttgtgacgacatggattgtagattcaatggtcctacacagggtatctaaaatgtcatgttgctgcatatgactaaagagtcctctggaatggccacaactgagagataaagcaacctcagggtcctgggagggcaaagcttggccatcacagcttctcaagtcagctaagtcagacagaactgcagagatagaagtagaagggaactcagattcttcctcagctagggtagaatccttggaacagtggaggtctttaaattctttacaatcgtcatatctaccattgttggactgttcttctgcatgctgtgacctgatatttgacatgtcttctgaaaacgaagatggaacttccattcggtattctttaacagaactattttcaggggaaggaagatcttgctcagttcctggatcaataattgaggagtctctggtctcattgtcagaagtgctcgtttgggtcaggacctccctggtttctgttttcatgtcactgatgcagctgtctacagtgtgctcctcatcactgctaacacgccgccttttaatgggagttgctccttcatcatctgtgaaaacacatgccaaaagggaaacttctctgaaagtcattaagatcacgttagggggggatgtgggaagttaattttgtttctagcatttatatttaggaggttcagctgaacacacaactcttaaaccagttacaccaagtgtattactccctcctcccaccctaaaggtaatgatagtagtccataaagctaacctttagtttt

SEQ ID NO: 827 - DNA, 1642 bp, Homo sapiens
agctgttgaggccaccctggtggcaccaaagccctctcaggcaggcagacccagggcctccccgccacaccttgttcatggattttgtcgctggagccatcggaggtgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttccgtgtcttttggcacctaccgccactgcctggcgcacatctgccggctccggtacggcaaccctgacgccaagcccaccaaggccgacatcacgctctcgggatgcgcctccggcctcgtccgcgtgttcctgacgtcgcccactgaggtggccaaagtccgcttgcagacgcagacacaggcgcagaagcagcagcggcggctttcggcctcggggccgttggctgtgccccccatgtgtcctgtgcccccagcctgcccagagcccaagtaccgcgggccactgcactgcctggccacggtagcccgtgaggaggggctgtgcggcctctacaagggcagctcggccctggtcttacgggacggccactcctttgccacctacttcctttcctacgccgtcctctgcgagtggctcagccccgctggccacagccggccagatgtcccgggcgtgctggtggccgggggctgtgcaggagtcctggcctgggctgtggccacccccatggacgtgatcaagtcgagactgcaggcagacgggcagggccagaggcgctaccggggtctcctgcactgtatggtgaccagcgttcgagaggagggaccccgggtccttttcaaggggctggtactcaattgctgccgcgccttccctgtcaacatggtggtcttcgtcgcctatgaggcagtgctgaggctcgcccggggtctgctcacatagccggtccccacgcccagcggcccacccaccagcagctgctggaggtcgtagtggctggaggaggcaaggggtagtgtggctgggttcgggaccccacagggccattgcccaggagaatgaggagcctccctgcagtgttgtcggccgaggcctgagctcgccctgcccagctactgacctcaggtcgaggggcccgccagccatcagccagggttggcctagggtggcaggagccagggaggagtgggcctctttgatgagagcgttgagttgcatggagtcggttgttcatcccagcctccccatggccctcgcctcccatgtctttgaagcacccctccagggagtcaggtgtgtgctcagccaccctctgccccattcctagaccctcacccccaccatgactgagggctcccggcccggcttcttccccacagcaggctgctcagagggggtgctgccgggactgccatgcccacctgagaggggcctggggtggccgtcctcggccggttagggaatttggggtgaggttcctcaggagccctcactctgcctgtggacgctgcacctgccacttaaagaccccaaagactctgttgggaactgttgtcaataaaatgtttctgaggatgttc

SEQ ID NO: 828 - DNA, 2564 bp, Homo sapiens
atctggcccaggaggcacaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggttccgggagaacctccaggacctgctgcccatactgcccaatgctgatgactacttcctcctgcgctggctgcgagctcgaaactttgacctgcagaaatccgaagacatgctccgaaggacccaagtccccccagcccacctcctgtccccacgctctgagagcctggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgctggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtcctgcgcttcgacaacacctacagccggatgtatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgggggtcctggttccagcagagcactggggcccatccaagtttgttctgccaccactggatggaaaattggaaatggactgggcgtggtggctcgcgcctgtgatcccagcagtttgggaggctgagttgggcagatcacctgagatcgggagttcgggaccagcctgggcaacatggtgaaaccctgtctctactaaaaatacaaaaattagccgggcatggtggcgtgcacctgtaatcccagctactcaggaggctgaggcaggagaatcgcttgtacccaggaggcggaggttgtagtgagctgagatcgtgccactgcactccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcagaccatctagattaaactcctaaagccagtgccacgaggcattcctgttccaactgggtgtttgagcagattggc

SEQ ID NO: 829 - DNA, 2096 bp, Homo sapiens
aggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggctgacgggcttctccggcatgaagggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtgaagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagtcgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaaggtgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaact

SEQ ID NO: 830 - DNA, 3528 bp, Homo sapiens
tgacagtgacttgggtcacatggtgcaagaccctctgtattgttcatggtacttgccatcaaaatgttcaaattaatggagcctgtgaaagcacaggttgtatggagtataaagcctatagagtttttttaaaatcttttttcttcttgaaacgtgtgcatgctgtttttgggaacaatacaaactgcatgttgaagtcagacaaattcaggtgctaaataatttgtttctctaatggacttagattgtatttgctatcaggttttataagagggctttttgtgtagcctctgaagttactctagtatatttcttatgtgtggagaggtggggcagaaatagaaaatgtcacatgttccccattattttaaggaaagaaaagataactttgtctcactaatttcatttcagacaagtggattttataggtaataggttcaattctcgatttaatttcatttccagagacactataaaatgacacaaaacttttccccctcactgttgtttttggaacaagacgacatatctcctggtaaatgcagtcatacatgatatggctcaatgcctggactgcctgccttgtaaataaccgatggcactcttaataaatgggaaaatgtttttccttagatttcatccacattttatagctaccatagcaaacacactgagtatttcaaaatagcactttgcctttttcctgaatgtgtgctccatgtcatcaagttcatcttactggaaagtttaagtggtgaaattagatggaacatactttgataatgcattgcatgtcaggttataaatatgaactggatttaatatttggccaagatagtcctcacaagtgcgtttggaaacatttgtcaaatgctgaacttagatttctggcctctcctgggagtcatctagatataggaaggcatcttagatgctcacctatacagtctcagtgctaataaaatggaatggcgtgggtgctgggtggtttataatgtgatgcctgtgggtggagaagtaactcacggatcttggccttttcactcttcacagaaactgcgccaaggccaagtcatcacattatacgggcattatgtgctgggggggttggggtgggttgcaggatgggagccttgatgatgaggatgggcagtgatgctgcctccaccagccatcagccaaccacaaccacaatgtacatcctctttgtctgcccttagctttgggactgggtagcagggagagggaaaactataagagcatttcaaagaaggagggaagttaataccttgaaaggagaactgacgtagaagcactccattgtccttacctcaatctggaatgggagattcccatctgtcagatcaggaaggataatgagctttgaaaagcactgaaaggctgggcgtgagccaccacgcctgtaatcccagcactttgggaggccaagatgggaggatcactagagcccaggagttcaagagcagcctgggcaacacggcgaaatcctgtctctacaaaaaatatgaaaaaattagcccggtgtggtggcaggtgcctgtaatcccagatactcaggaggctgatgtgggaggatcatctgagcccaggaggttgaggctgcactgagccatgatcacaccattgcattccagcatgggcaacagagtgagaccctacctaagaaaagaaagaaaagaaaagaaaagcattgggaaaggaagagggtatggtttagaaggcaataagaaatcttaggaagagtggagggtggtaggcacaagggatggtattaacaaaggcagagggaaggatacagaggagagggggggaaacacaaggaggatgtgggccgtctggccagaccaccttggtgccacagtggtgaccaaagtaaagaggtgggagaagctgcttccctcatttatctgaattgtaagctcagcaacactggcccagtagaaattcatgtacctgtagcagaaacttagctaaacacccttgtccttgaggcatttccacattttcagcttatttcgaattgttgccagcccagtttaatggtcttcagagccatcctgagtaaatgctggcttcaggtctccagctttgcattgtctacttttgatctctcactaaaagtaagatgagaagttgaaattgagacagcatattctaaactagctgagcctttgaagaattcttattagaaaaaatgaaattgcttgcgtgaagtgtgatggtgtgttaatacctacctagttacctagtatgagaatgatctgaattgttaaaagaaacaataggaaaacatattaggcattgttatttcaacaagaggattttaaatgtgtatcatttgagtatgtttatcttttaacctcagcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 831 - DNA, 2535 bp, Homo sapiens
ttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacattctcatctgttgatgggctgttgcccgtgatgctgccaggcacgccggtgtacacgtctgtgtgcccgtgcccctggtcctgtggctgcacgccagggccggaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtggcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggccaggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgaggtgagcatgtgtgggttcgcctgtccattcccatcccctgggggttctggccaaggcggtgcaccacccccagccgctcctccacgctcatcttcgtggccccgtgtccccgtgcctgccccagccgctgttcacctccctgcagggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaagaacactgcgtccccacggcctgcgtggcgctgccgtcccccacgtgtactgtagagtttgttttttaattaaaaaatgttttatttatacaaatggac

SEQ ID NO: 832 - DNA, 3919 bp, Homo sapiens
gaatctggtccgagcgcgggaaacggcgggtccccgagcccagtaccagacctcctgtgcgaagagtaacctgctcttcggactgataactggatgggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagagatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagaggtaactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtataaatggtgtagaaatccatgattccaagaaaaaacacttttctagcaaacctggttgtttttaaaatgacttttatatatgtaatattgcttggaaactatgagtaataaagcaatgacaac

SEQ ID NO: 833 - DNA, 2768 bp, Homo sapiens
agttgaaataactccttcgtggaggctggctacattttcacaacgtctggtcccaagctagatcttcgggaaaagggatcaaggaaatgactattcctccaaataaaatgcaacaagaagaatgaaaaaacgtagaagagaaagcctcgtgaaactgagaagcatctgcaaccacaaactacaaaatgtagctgctaaacaaaatgaaagttggatcaaagtggtggcaaatatcaagagtgaatatactccacggcagagtactgcaaatgctgcacatctttcatggattctggtccacctcgtcctcacgcggggatgcagactgacaagcttccaccatgaagggttgtcatttgccatagcagggagaggaaaatggagcaaatcagtcaccagctcgtcatacagaagagtgtcccacgtcatatctgctgatatgttatggccaaagtacatgactatctccaaggagctgagaggtgaaattcggacatttgtctggacggagtagaaccaagagagtcgtaaacatcctgtggactacacaccgtttaacaagatgcaacagtattctggctttgcctttcctggagcccttaaacaggctgaagtgaaaagcaccatgacctgtcactacaagacgagaagcctcaggagaaggaaggagatcccttttcattggttttgccgagtttcccgagctccatcctcctacagttaaatcaacactctttatccttagactgctgataatctcaccaaccgcttcctggtaagatctgtaatgcgtgaggtcttccttcttagttgtttgcaaacatcagtgattagggacaattagggactggtgtgcctgtcattcttctcctttcagctgaggaggaaatcctcatgcaccgttatcgggagtgagacttcatctgtcagctgcagtctcaggaatccacgggttcattcagtcgcaactccaatctcactaactttatctgtgttcctcaaatgccttagactatttgcttcccactgatagggaaacctgacatctcattttctcagtgtccagacaaagattcgtacatagcaagaaactaagataggtgttacagaacgtggagggaaccaggaaaaccaaatagaggacccccttcatggggcttccaacacgataataggcaaaagagaagaaacatacatgtaagagacaagcaaaacccagaaccatcacttatgaaggatgtcctcatcaccctcctttgctgcctgtcaaaaccggtgagggctcatatgacaccttaattatgaattaatcttcgttcctcctacaccagcacttcccctcaccccagtcgaagccatctctttatatttccatagcttaaaatgctatttttggttctagatgctttgcctctagatttggatactgcatccatattgttgtatattttttcctttctatcttttccacaatgttttttttttttttaacttttaagtttaggggtccaagtgcaggtttgttacataggtaaacttgtgtcatgggggcttgttgtacagattatttcatcaccaagatattaagcctagtacccattagttacgtctttcttctcccaccctccaccttccaaaaggccccagtatgtgttgtacctctctatgcgtccatgtgttctcatcatttagctcccacttataagtgagaacgtgcggtatctggctttctgtccctacgttagtttgctaaggatgatgggctccagcttcatccatgtccctgcaaaggacatggtcttgtccttttttatggctgcatagtattccatggtgtatatgtaccaattttgctttattcagtctaccatcgatgggcatttaggttgattcaatgtctttgctattgtgaatagtgctgcaatgaacatacacgtgcaggtgtctttatcatagaattatttatattcctttgggtatatatccagtaatgggattgctgggttgaatggtagttctgtctgtaggtatttgaaggatcaccacactgtcttccgcagtggctgaactaatttacactcccaccggcagggtcaaagcattcctttttctccacaacctcgccagtgcctgttgttttttgactttttaataatagccattctgactggcgttagatggtatcttgtggttttgatttgcatttctctaatgaccagtgatgttgagcttcttctcatgtgattttcagccacatacatgtcttcctttgaaaagtgttcatgtcccttgcccacttctttatgtggttgtttgtttttttcttgtaaatttatttaagttcattatagatgctggatgttagacctttgtcagatgcatagtttgcaaaaattttctcccattctgtaggttgtctgtttactctgttgatagtttcttttgctattccacaatgttttgtgcaagataagtgcttagcaaatgcttgtaaaggaatgcctgcaccaggaaagtccaatagctatgaataaagaaagaaaggacaagttccaggggaggtgatttttttttcattttcatttttttagacagcttttaaaggaatggagtagcatgttcttctggagcaggagttacaaattgaacctctaagggccacattcagcctatccacatggttgcagcactgacagagtgttttgaaattttaaactctgaatacttgtagataacatatgcatgccacaataaactgcatttccatc

SEQ ID NO: 834 - DNA, 2780 bp, Homo sapiens
atatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacgggcctccctcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtcagctgcccgcagggaacgtattaccacggccagacggagcagtgtgtgccatgcccagcgggcaccttccaggagagagaagggcagctctcctgcgacctttgccctgggagtgatgcccacgggcctcttggagccaccaacgtcaccacgtgtgcaggtcagtgcccacctggccaacactctgtagatgggttcaagccctgtcagccatgcccacgtggcacctaccaacctgaagcaggacggaccctatgcttcccttgtggtgggggcctcaccaccaagcatgaaggggccatttccttccaagactgtgacaccaaagtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactcatccccatcctccattaccacttatgagacctgccagacctacgagcgtcccattgccttcactgcccgttccaggaagctctggatcaacttcaagacaagcgaggccaacagcgcccgtggcttccagattccctatgttacctatgatgaggactatgagcagctggtagaagacattgtgcgagatggccggctctatgcctctgaaaaccaccaggagattttaaaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgcc

SEQ ID NO: 835 - DNA, 2918 bp, Homo sapiens
gtgcacttttcggcccccgtcgcgggagccgcttcgggccttctgggcatgtctgccatatggctccaggtttgtttttctccccggcactctgacggggagggctcccggcatctcctggcgtccgggtagaggacgcggaggatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatg

SEQ ID NO: 836 - DNA, 3799 bp, Homo sapiens
gatttcgctcccagcggcgtctacttccgggtcagagctcagacctagggtgtagagaacaaccttccgtaacaggcaggaatagtcgaaataggatagcgtcgtctttcttaaagtgacaggctcaaagcaattggggcagccctatccagaagttgtgagggcgactcagctattctgaatccaatcctgggcaaagttctggacaagtctcaggtttctgccaatggggaagggatatgaagaagcggattgtttcccaggtgaggagaagaagagagccttaggcaatccactccaagagcttgaggtgcagccagttccgtctgtcctccagtcttccccaccccatccaactagctctacgaggcagagctttctcgtcctcatatcatatatgaaaagaatggccgggcgcggtggctcacgcctgtaatcccaacactttgggaggccgaggcgggaggatcacgaggtcaggggtttgagaccagcatggccaacatggtgaaacccgtctccactaaaaatacaaaaattagccggccgtggtgccacgcgccggtagtcccagctactcgggaggctgaggcaagagaatctcttgaacccgggaggcggaggttgcagtgagcttagactgcgccattgcataccagcctgggcgacagagcaagactccgtctcaaaagaagaaaaaaagaaaaaaaaaaagaaagaaaataatgaggctcagaatcgatggatcgcacagtcccacaacttcgcagccaagaccagactcgggttcacccccttcccaagtgtggttctgtaaccccgttttgctgccgccgatgcggatgcagagggcagagatggcccatccttagcagagaccaacctccaccctaggcagcagagcacgcagctgggggcttttctttctagatctcaaaagcctgctgtgatgggggatctggttctgccctttccctctctgcctctcctggcccgcctacccgggaactccccgcctggagcctctgggaggggagcggtgcaggccgcccgcgtcatctgatgctgtttcctgcaggagggagaagagcggaaaaaagtgaaactccaccctccacctctgcctcccgcccccggggccaaagtacaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccagcctgaccacactgccctgggtgccctcctccagaagcccgagatgcggggggccgggagacaacactcctggctccccagagaggcgtgggtctggggctgagggccagggcccggatgcccaggttccggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggtggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggaggtgcggcccttggtggggctggacgggctgctacggggctgcagagggcagaggtggctgcctaaatctagggctgggccaagtccagggacagggacccaaaccacttggctcctagttgcttttgggtgaagtggcagtaagggggtgggggttgggagagaaaagggaacacagacctgttgtctcgcccacagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccggtaagaggacggggagggcaggtgaggtacagagctccctggcccaggacacatccacccacggaccccttcttattctgtccccgctgcacgccgtgcccctagactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagtgtatgaaacttcacctctcatgcccctctccgccccccagctccttattctctgtcagaccttattcttggaggcggagcccactcactatcccctcttcctccccgcccccaggctccctgccttaggtctagcctgttacctctgaactccccaagcagcattaattttacttatttttttttagtcaaataattgtatgacactatgtactactaattttctaaatgctttgctaatattaatttcttgcaat

SEQ ID NO: 837 - DNA, 3072 bp, Homo sapiens
attccaggagccctccgttctgcgggctgacaattagccaaagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaatcgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagtggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaaaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagt

SEQ ID NO: 838 - DNA, 2083 bp, Homo sapiens
agagcgggggcggggaggcgccgtctggctcaggctggggccggcgggagcgcgaacgagcgacggcggtacccgtgggcctgtggactgcagcctcggcggtcagcagcaatgaggtcttactgtgtagcccaggctgctctggaactcctggactcaagtgatcttcctaccttggtcttccaaagtgttgggattacagatggagtttcgctcttgttgcccaggctggagtgtagtagcatgatctcggctcactgcaacctccgcctcctgagttcaagtgattctcctgcctcagcctcccgggtatctgggattacaggaagtttatctcgacaatgctagttgcagtctgtgtgaccctgaccaagttattttaatgtctgtgctgcagtttttcagtttccaagatggaatagttatagtgcatatcttcctcatggttgtgaggagtgcatgacacatagcgagtgctcagtgaacagtcatttttctgagtgcttgtgatttcacgtatttttgctgaactcgtaaaagagacacttggatggtggattaaccagaacactaacactctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagtcccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcaatcatggatatgatatcactgctctttatttaaaagtaaactttgggcacaggaaccatatgggaacattcagcttgtt

SEQ ID NO: 839 - DNA, 2353 bp, Homo sapiens
atcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccaggtgagggagggccttgagggcactgctgtagcgggacagggacatgtggagtcgggaggctgtttggtcctgagctctgagatgtagccctgaagctgtccctacctttggaagcagaccagtgtgctgggcctgttttactctggcaccagagacccagactctccatcaccccatgagcataccctctctactttattaaccagaaggcctggaaatgcccaatatacccagagaaggaaactggaacagaggtctccggggtcccttgccctggagcaactctactttaggggtcattttggtccagctcaggaagcacagccctcctccaccccctcccccagcagaggggctgggaagatatggcctccctttgtcccttttggcccacaggattcctagctcacctttcctctactccagatctgtcactctgtcttggacatctaaactcaacctggcctctccaaagaggggtcaccaaagacactatgagcttagggggtaagaggggacatagctctagtctcagtgggcccagccctgtcctggggtgcctgctatggtggggagacaatgccctgtcctaagggagcacctggagggtaggacataagatagagtcttcctggataggaataggtgtttctaaatctctagagaagacagtggaagtcattcctttgcaaacccactccctccaccctgtctgcagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtaaggcagccctgggatgggctgggctttatggaggtcctaggtatgggccatgaggggcctctaacctagatgacgaccctttgccccttctccaggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctgtcctctcttgcccagccagcgggcagggactgtgggttggtgaatgcattaaagtgctttgggg

SEQ ID NO: 840 - DNA, 3428 bp, Homo sapiens
cagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacagaggctgcaagtcgggccatagttcagttcctagagattaatcagagtgaagaagccagtagaggctggatgcttctaacgacaattaatttgttagcttcctctggtcagaaaaccgtggactgcatgacaacaatgtcagtgccttccaccctggttaaatgtttatatctgttttttgaccttccacatgtgcctgaggcagttggaggtgcacagaatgagctacctctagcagaacgtcgaggactactccagaaagtttttgtacagatcttagtgaaactgtgcagttttgtttcccctgcggaggagctggctcagaaagatgatctccagcttctattcagtgcaataacctcttggtgccctccctataacctgccttggagaaagagtgctggagaagtcctcatgaccatatctcgtcatggtcttagtgtcaatgtagtgaagtatattcatgagaaagagtgtttatctacatgtgttcagaatatgcagcaatcagatgacctgtctcccctagaaattgtcgaaatgtttgctgggctttcttgtttcctcaaagattccagcgatgtttcccaaacacttctggatgattttcggatatggcaaggatataattttctttgtgatctcttgcttagattggaacaagcaaaagaggcagaatccaaagatgccttgaaagatctggttaatctgataacttccctaacaacatatggtgtcagtgaactaaaaccagctggtattaccacaggggcaccctttttattgcctggatttgcagtacctcagcctgcaggcaaaggtcacagtgtgagaaacgtccaggcctttgcagttcttcataatgcatttttaaaagcaaaaaccagcttccttgcccaaatcatccttgatgctatcacaaatatttacatggctgacaatgccaattacttcatcctagagtcacagcacacattgtcacagtttgcagagaagatttctaaactcccagaagtacaaaacaaatactttgagatgctggagtttgttgtttttagcttaaattatataccttgtaaagaacttattagtgtcagtatcctcttaaaatctagctcttcttatcactgtagcattattgcaatgaaaacacttcttaagtttacaagacatgactacatatttaaagacgtgttcagggaggttggccttttggaggtcatggtaaaccttttgcataaatatgctgccctgttgaaggatccaactcaggcactaaatgaacaaggggactcaagaaataatagttcagttgaagaccaaaaacacctggctttattggttatggagaccttgacagtgcttcttcaaggatcaaacacaaatgcaggaatttttcgagaatttggaggtgcaagatgtgcacataatatagtaaagtatcctcaatgccggcagcatgccttgatgactatccaacagctggtgctctccccaaatggggacgatgacatgggcactctcctggggctaatgcattcagccctaccgacggaattgcagttgaagactgatattttaagggccctcctgtcggtccttcgagaaagccatcgttcaagaacagtttttaggaaagttggaggatttgtgtacattacatccttgctcgttgctatggaaagatctttgagctgtccacccaagaatggctgggagaaagtgaaccagaatcaagtgtttgaacttcttcacactgtgttctgcacgttgactgcagcaatgcgctatgagccagccaactctcatttcttcaaaacagagattcagtatgagaagttggcagatgctgttcgatttcttggctgcttctcagacctaagaaaaataagcgccatgaatgtcttcccctcaaatacacagccatttcaaagacttttagaggaagatgtaatctcaatagaatcagtgtcacccacgttacggcactgcagtaaactttttatttatctttacaaagtagccacagattcttttgacaggtatggctctgctctgtcctctgaattaaagggtgtatactaagcatgacttcaacattaagacttgaattatgagttaatccaaaagaatatgaaaacagatgactcttctcctatttgtttgaagtgtatcactttatttttgaatattactcttgctctggtattgtttttttttttttttagcatggaagcctgtgtactatttgtaaattcaggttcaattagttctcattgcagttattggaacagtttctatgaagtttcctttaatgatagtgtttactgttgttttttttctttttagcctcaaaaggtgcatctggacttattgatatgtgttatcaatagaacatcattatgattattcttatttccagacacgtactccatcattctccacatatcatactcctcaaaaaatgatatagttcccaaagagaggtgtcagtgtcttgaaccgtcaagttcaagaggccatcagactcaatatttactcattccttcatgaaataagtacttaacaaaaagctgctgcatgccaagtcactatgctaggcattgaggattcagctctacacagggctgtcttggtccttgctatcttttagctaaaatgtagacacataaataaacaattacatatagtgtgacacattctacagtgggggaatccagggttctcaggcagattgtaggagagccacttcatctagatcacttattttcagtgcttcaactgtgttttcaatgaagatgtcactttgaaaataatacttctaatttatgccccaagtgttattgcttttaacttaccatagttttactacataaaataaatgaactgccctcatcaatagaccatgtaactacattggatagagcttgtaataggttttgtgtccttttctgtggaatatctgctttgaagtatcaactgagatatttcctgcttcttaacaagatttcttagtcctcagtatttacatttaaaaatccaaacagctttgacaacaattgt

SEQ ID NO: 841 - DNA, 3476 bp, Homo sapiens
attaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgtgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaaatctgtacatattggagctctgggagatgctggaataaaagacaagagttacatctgg

SEQ ID NO: 842 - DNA, 3389 bp, Homo sapiens
gggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatattttgtgcttagacaaattcaaaatgaggaaacatcggcacttgcccttagtggccgtcttttgcctctttctctcaggctttcctacaactcatgcccagcagcagcaagcagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctccggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgccctt

SEQ ID NO: 843 - DNA, 3054 bp, Homo sapiens
tatatcatctgtatttttaaaaaaatcatcaaaataattttaaaagaagtgaaaatcatgtatagtcagaacaaacacggctgggcacagtggctcacacctgtaatcccagcactttgggaggccaaggcaggtggatcacctgagttcaggagtttgagaccagcctggccaacatggtgaaaccctgtctctactaaaaatacaaaaattaattgggcacggtggtacacgcctgaaattccagctacttgggaggctgcagcaggagaattgcttgaacctgggaggcagtggttgcagtgagccgagattgtgccactgcactccaccctcagcaacagagcaaaactccatctcaaaaaaaaaaaaaaaacctcatatacacacacatccgtatttatctccattgtaggggaagaaaaagaatgggactatcagccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtggtgagccaagattccaccattgcactccagcctgggcaacagagcaagactctgtctccaaaaaataaaataaaataaaataaaataaaaagaatgggaatatatgctatgaattctttgtggggtttttttggtgaatatttatggagtgtttgctgtgtagcaggtgttgctctaagcagttttcttatatcaaacacacttaattctccccagcaacctatgagagaggtaatattcccattttacagatgaacaacagagaggttaagtaacttgccaaggccaaacagctcgtgaatagcaaacctgggctagaacccaggtaatgtggctccagaacccctgcttttggtcgttctgctattctatgaggtagtcattatgatccccctcatcagaaagcagaaagcatgagattcagaggggtgcaattacttgtccaaggtcacacagctcatcagggaaggagctggtacccaggcccagatgtgtgggtcacacacccagactccaggccacctcccagatctgaggccgctcctctggagtcaagtctgtgcctgggagaagcaggaaggaccactggacctgctgtcagtggggcaggcacaggctttttccagtcccaggctgccccctactggcagcaggacaaacagcaggtgcctgggcccagctaggataggaagggtgaggatgggcctaagcaggctgacacagggctgagtcctcctctccccgctccagttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtaat

SEQ ID NO: 844 - DNA, 2239 bp, Homo sapiens
gacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaagaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgctgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattg

SEQ ID NO: 845 - DNA, 3055 bp, Homo sapiens
aaaagagcccgctccgccgagcgccgggcgacggcaggtctctggggttgtcttcttctctgtggagactgccgagcgcctcctagccacccacgtgagcccgcccctggatgcctgcacctacctaggcttggactccggagcccggcctgtccagcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcaggcgctggctgcttggtgactggcctggatacagcccactccaaggccctgcatggccgggagctgcgtgaccttgtcctgctgggacaccacacgcggctacacggctccccgggccacgccttcaccctcgttggccgtctggacagctgggagccctgactgcttcttcctctcccccagagacagggggcaggcacatatctcaacgtgccctggagtgaattcttcaagaggacaggtgttcgagcctgggacctgtgggaccccgagacgctgcccgcagagtactgccttcccagcgcccgcctctttcctgtgctccacccctcgagggagctgggaccccaggacctgctgtggatgctggaccacccggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagatcgagggccttgggaattacagcatccacctggttgaagtggacactcagggcctgagcctgaagctgctggggaccgaggcctcaacctgttgccctttcccatgaagctggcttctctctgcaacaggaggaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgc

SEQ ID NO: 846 - DNA, 2467 bp, Homo sapiens
agatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgatactaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggcggagatgggagaatcacctgagctcagaagatggcagctgcaataagctgagatcccgccactgtacgcaagcctaaacaacctgagtgagaccctgtctcaaaaaaacaaaacaaaacaaataccctccctgagcttcagttcccctaatggtaaaatagagaaaataatacctatgctcagtgtgcagtcatttctccatgacggtactcgtggcaggcattgctagtcgatccatgatactctttcctctaactgccatcaattaaagatggtacttgagatgaaatatttctgcagttccacaaactcatgagcttttttgtagagaacttatttaagagctaatatgtacagaatttctagtagaattctggcacatggtagacaatcgttacgacatttggctctgagttccctgggggccggggcaaaatgagaaacacattaagctacatagtcttgttatcaaagaaggggaaaccttacttgtttctcaggagttggtctaggttatagtcctggtgttagtgtttggcctgaagcaggtcagtgttcctaagagtttcctttttagtgggcgagttcaagggactttaacttgtgtgatttgtctgcttattccagagaaagctctgggcttgtactcctctccagctgtccccagacagctagtcgcctccagaagtacttcacccatgcacggagagcccaaaggcccacagccacctactggtgagaggtgctgggaggttcctagagtggtggggaggtcccagcaagccaccctgtgacctcctcctgcccctttctcagtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatgccactgcactccagtctaggtgatagaggagacttcatct

SEQ ID NO: 847 - DNA, 2649 bp, Homo sapiens
cttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggtgggctggggttggggttatgagagggtgcactggggcaggggggcatggagggcagctgggacagcaggggatgaagacacctgcgccctccatgaagcggggctaaaagcagctcctcccctaggccagagccacccttgcacattcatccagtcacttatttctgtattcatgcagcaactatttgctgagcacctactatgtgccaggtactgttctaggctctggggatatagcagagaataaaacacagttcccatgcctacgaagatgaccttctatcggagacaataaaacagcaaataaataattgcacagcaaggccgggcatggtggctcacacctgtagtcccagcactttgggaggccgaggtgggcggatcgcttgaggccaggagttcaagaccatcctggccaacatggcgaaaccccgtctctactaacaatacaaaaattagctggatgtggtggtgggcacctgtaatcccagctactcaggaggctgaggcatgagaatcgcttgaacctgggaggtggaggttgcagtgagccaaggtcacaccactgcactccagcttgggcaacacagtgagactccatctcaaaaataataataaagataataattacacagcatattgggttgaaatatgtgccctggagacacacccagggtgaaggggagagagggggccaggatcagggtgctgttgtatatgtgggggtcagggaaggtttctctgagaagggggctttagagcagagacatgaagatggaggggaggctccccatggatgctggggagatggcagcgggcacagcacgtgcaaaggccctgaggcaggaggtgctgggtgtttctgcttgaggagcagcaaggaggccagcatagctgtcgggggtgggagaggaagaaacagcaaagatgaggtctggggtatgggccacactatgtagggcctcggaggccgtgaggccttggccttctctctgggtacagcaggcatcatggcctctgtctagaccctgaaggcttggggcctcagcccctcccaatcccagtggcagccaaggcagaaccccaagaaacacacttcccccaacccctcacccatcagggcccatgcacctgcctgcccctgcctcaggacacctgcccctgcctcaggacaccacctgcccctgcctcagcacatctgccccaggggctgcccccggctcctattctctggacaaaatatctcctccctttgccttgaaggctgtagtgttcagaccttcccccagcccattgggctccctggggactgactcccccgccaccactgagcttctgccaccggccgcctgccggccttcatgagacttgacctgacgtctgtctggtcccttttctcccttcggctctgattccacctcctgccttcccatcccagctgcaggagcggggccctacaaaggcagcagtagcccagaacattcaacctggtccctccctctggacctggtcacccccctgtccccaccctcagcaggcagcatctgcccagcgtcacgtgcaccctctcagtttaaccctttggtgaatctggttgggcaaccacacccagtggcccccagaagaggctcagagagagtgtgttcttgcccaagggcatgcagccaggaagagcagagccagagtttgaacctggctcaaaatagcccagtctcccaaagtcaggtcccaggtgacctaggaggtgtggcgggcaggccaccaggctcatggggccagagcacaggctgtgggaaagtccgtgtggaaggcaccttcccccagcctcagtggctaggaggtgccagtgggcgtggcgtcttcctccctcttggggctcagctgtagccctggccttgcccctggttcgctgagtgacctcaggcagggcatctccttctctgggcttcgctggtcctctggcccatccagcaccccactggcccgtccccctctgccctgacccgggagagcctgcaccccataacctcaggcgctgcctcaggcagggagccagcctggccccagtgtccctgacctgttctccagcggcctgcagcctgctgcctggctggtctctcctcccttggggtgcagagggcagggagcactggctagccgagagcaggacaatgtccctattgattcgggtctcctcactcctgcttagaagcctgacagtggccctggcccctgggctgtgggaactgacagcatttacctaggggtggctgtgcctgtgtctcctgtggaccaatctcgaccctgctctttgggagactgaggtgggaggattgtttgaggccaggagttcaagacctacctaggcaacacagcaaggcactctgcaaaaaatcaaaacaaactttttttgaaatt

SEQ ID NO: 848 - DNA, 2188 bp, Homo sapiens
acttaaggcttccgggcatgcgcacagcgttgtgcaaatgaatgccttccactgaaccgaggcactgttatagaagaatggaagaagatacagattatagaatcaggtttagttctttgtgtttctttaatggtcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactg

SEQ ID NO: 849 - DNA, 3044 bp, Homo sapiens
tatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacaggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacaccc

SEQ ID NO: 850 - DNA, 3914 bp, Homo sapiens
attgccatgcggggcctctaccgctgccatcgcggtcccggtctcctgaagtggaacccggcttggagtcgagcgcgacccctcgcccgtgggcgcaggcgatcgagtaagggtggggcgggcctcaaacccggatcagaacccgccctgaccggcgcagagatacgggacgcagccgtgagcactgttttttatttcaccatggacccatcggcgtggggcgcccgccccgggtgtccttcctcccccgggcagccagatgctggaacgggaggcacatgttccggccccggcccctgggaaggaaagaaaggaccttcccgtttcacttgtctcggctgaacatgtagcggaggaggtcgaccacccggtgactgtagccatattcgttgtcgtacctgtggaggaggggtcgggaggttcaagggggttccttccgaccaccccttagttcccctccctctaagtctccagctccttcccccttaccatgaaatgagcttcacgaaattgtcattgagcgcaatgccggccttagcatcgaagatggacgagtgggtatcaccgaggaagtccgtagagacgacctggaagtcagaatttcaaagataagtgtgtccggcagagcaaggacctccaggagctgaggccccgactcttaactctatcgcccatccatgcattcatctataatatttgatgtagccctactgtgtccagtctctggactggagggtatgaccaagtgcagggtatgaccaaggcactgtgtcagggtctggccaaagggcacaggtcacaaacaccctcatgctgtaccagtacatccctttcctaggaataatgcaagcgtttggaatgggccagcatggagggcctctctgaggggtggccatgagcctgggtctagatgactagaaagatctgaccggctggggccctcagcacagtgtctgaggtagaaggagctgcaggaagggaggacctgagggttttagccctagtgtcatgaaaggccacaggagtgttttcaatcctgaaaacgggtgatgcaatgtgattccattaaaacaaaagatcccagtgactgtgggaaagtggacctgcaggagttaatgcagggagacagcaccaaggtggatgtacaggggtccaccatgaccatggcatccactcctcacagagaaggcatctggccatggcctggccctgagcaagtattgaaaaaaatgggagctgttgtcttttgttcactaagcatgtattagtcacctgctgtatgccaggttggagccacaaaagtgaaaaggcagcccctaaatccctgttttcttggagtgcacacaccactggggccaacagtgactatgaaatgaaatttcaggtgaggaatatggccacaaaaagaacatattttgagggggtgccttgctgaagagggaggttcctccagagacttggaggaagtaaggacagactgtatggtcacctggcaagggaagcattccagactaaaggaacagcaagtgcaaaggccctgaggcagggagatctcccttcctgccctgcagtttctgacttggcacattgagagcagctccctggcaagtggaaatcatgtcccttcccagagggctcctcccagggtctcctctcctcagcccctacctcatcctcggtgtaggcaaggatgccagccatgggccccttggctgctgcttttacagcctccttgatggctgagtagggggcaggctgggcgaggcggcaggtcaggtccacgacagacacatccggggttggtacccggaacgccatccctgtcagcttcctggagaatcccccatgaggaacaggagtcagaacttagggacgttgccctccattccccctttccctgtggctgggccaggcccctgctttcctcttaaggactgagggccgggccagtccagtcctcctggcgtatgcccccaccctggttgcagcttcttgtcctcataccctttgagctctgggatgactttggtcacagctttcgcagccccagtggaggctgggatgatgttctggtgggcaccccgcccatctcgccaggccttccttgatggcccgtccactgtcttctgggtggccgtgtaggaatggactgtggtcttggggaagagaaggaccaagatgaggccttcatgctcctaagctcccatgcctcttttttccaggactaagttggtggcctaggtgtggaggctggtggggccaccaccacagaccacaggaggggatgtgtgcaggccagggtccagccttgcctgagggttgcacagtgttttaagtgacttctgcactggtgggcctctcctcccgaaaccagtctctccctcttaactccatacagtaagcaaggcccgggaagaagttgggtttccctgccatccttcctgccccagcccctcatcctcaactcaccatcaacccttccacgatcccaaatcgctcgtggatgactttggcgaggggagccaaacagttggtggtgcaggacgcgttgctgaaacagccaaggtgtgcacggacactgtgaggtgagtcgcagagccacccctccacccttacccctcttggggtatgcacgcagacttggttttatgaaacgtcaggatgagggtgagagggatctgtggggacactgtcagactgaaggaggcactgaggtgcagctggggaggctccccaagcttgtcctctggaagtcatgcgtttttagcagatagtttcgggaaggagaagcagaagccaagcgaccaggaatccagtggggctgagggtggggaggacgagtctaccctcccttccacacattgcaggatgtcactgcccacattacctcacaatgttcatggagccagggttatagtcattttcattgacacccatgacgaacattggtgcatccggtgagggcgcggagatgaccacacgttgagcacctgcagagatgtggtcctggggaggaagcgcaggtgtcaggggcttctggcaccatcatccccccagctagccctgggcacctctccccagcttaccgaagctgcctgtatggagaggtacacgcctgtggactccaccacgtaggggctcccgacagccctccaggggatctgtttgggctctttgctgtggggaagtggcagggctgagtcagtctcccctgcttgagccccaccttcatagtccatggctttcaccatttgacaggctgagcaggtaccggcccacctgcaaccacctgcgtcccctaccccacacacctacttgttccagatgggctccaccccgctggcctagcttttcaccactgccccacttcagaccactttccctttgctgattgcaccacccctgttatgcctgggtacaggtggtgacctccccaactcagccctcaacctcctcagaggcgccaatgctgactgctgtcagccagcccagaccctttctccatatgctgcccgggacgtggactctgtgactgtgaggcctgcccggctgctttctgcttcccagctctgacaacctcgccatgaaccctcctagaccctcagctcctgcaataggaagctggctgccaaaggccaggagggtccctgaaaacagacactgcattaaagaaaaagctcctggaggactcctgaagcctgaggcagccttggggcagcagtggctcatggtttacattggaaaggtaagggaggtttctggtttcctgttttataaatttatgtttttacttggtattttgacaaacatttgtatttgaagcacactaaacatctagtattgccgttttctacttggctttagcaaacaagcattaagtgaataaactgttccactttcttccttcccaggtt

SEQ ID NO: 851 - DNA, 1829 bp, Homo sapiens
atagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggtcaaggtcctgctcaaccggatctgctggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgcccccttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcc

SEQ ID NO: 852 - DNA, 2613 bp, Homo sapiens
attgattcgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatatgaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccgttttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatctt

SEQ ID NO: 853 - DNA, 3119 bp, Homo sapiens
acatctctcacgataaatgagtggggagaacttatagcccttgaagtcaaccatctcacacctttccaaaggacgcgaccataactctaaaaggctccagatggaccctgggaaggacaaagagggggtgccccagccctcagggccgccagcaaggaagaaatttgtgatacccctcgacgaggatgaggtccctcctggagtgaggggcaatcccgtactgaagttcgtgcgcaacgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttaaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcattttgctgtttttctttcttcgtcttctttttgggagctgccagagctgcctgggcctgaggctccgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctgtccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgtttttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcctatggcctgaaagtaaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagtagtctccaataaacttgtttctttcactgtg

SEQ ID NO: 854 - DNA, 2823 bp, Homo sapiens
actccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggtaggggcgttccccagccgccacctcagctcctcctccgaactgcccattgtgtctaggccaccccctcccacagtgggattccaggcaccgctcggcccctctcatcacaaaaacatgcatgcagcttacatctggtcaccccatctgattcctgccacacagactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggtaagttactgggagtttgcaagacggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaacc

SEQ ID NO: 855 - DNA, 2231 bp, Homo sapiens
aaaaaaacagcagcgcggctctcagggatgactctgtgagactgggaggatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagccagccgggggaccacagtgctggacaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattactgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggattacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggaaaactgcaaattgctcaaaatactcatgagctcttctagcgaaataatgctttcaggtaaaactaatcattctccaaattacttaacataactttacctctatccacaaaactgggacctgtcttagggacatgttaagcctttgctgaaaatcactagtctggtagtttggaatctcatcagacaatcaagaggaccaaattcatggttccatgagcctttttctttttactcaaagaaatagctaagccttagagagccatctcaagatgcctatggatggggagggcaatgcagggacatattacaccttctttgagtggctttgggctgtctgaacatttgaatcccagcttctaaatggtaactgtaaaaagccctgatgtcattggattatgattaagaataagatttttaggccaggcatggtggcttatgcctgtaatcccagcactttgggaggccaaggtgagcagatggcttaaggctaggagtttcagactagccccagcaacatggcaaagccctgtctctaccaat

SEQ ID NO: 856 - DNA, 2271 bp, Homo sapiens
gttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccctatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaagcaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattcaacatctttattgaaaatttgttactttttttaaaggtttttaaaagattacaattttaaaatattttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaaaaaaaaaaaaaaaaac

SEQ ID NO: 857 - DNA, 3478 bp, Homo sapiens
ctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaaaaggaagtggaagccccctacctttcaagacgaagtggcactacaccaggatgtgaaagtccagcgaaagagacccaaggggcctagggggcagcacacccccagaagccaagtctattccaggcagtaccagggattagggtctgggctggaaaaatcctggtgttttgaatatgttcaggtccagttcagactcttgatcccacagccacttcttgagtgagccctgaatctgtggaggctagtccagcagttaatgagaagagcgtgtattccactcataattatgggaccactcagaggcatgggtgtcgaggactgccttatgctcatgacgaagttgccccttttgcacttccctgactccagcggacgtctagccccgcatcattgttcttgtttttatgtcccagttgaccttggcattttgttttatcactttcctggttgaagccaaaaaacaaagggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgtgatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttatagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaataacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattcc

SEQ ID NO: 858 - DNA, 2216 bp, Homo sapiens
gtagtcctagctactcgggaggctgaggcagaagaatcacttgagcctgggaggtagaggttgcaatgagccaagaccacatcattgcactccagcctgggcaacaagagcgaaactcagtctcaaaaaaaaaaaaaagctgggggcaggggggtggatattacagaggatacagatgaaccgccagatggaagagatgcatagggcaagggatgtgggaaggtccacggacctttcatgccctctctggactcactaccatccgggaaccaccaagtgttcagctgtgtggaagctgtctgaacccacccagccctttggttgttgtcgttattgttgtttttgagaaacaaggtcttgctctgtcccccatgctggagaacagtggtgcagtcttggctcactgcaggcccaacctcccggcctcaagtgatcctcccttctcagccacccttagtgctgggatcacaggagccagccaccacacccagccacagtggggtttttatggaggcttcatcacagaggcatgatcatcattggcccttggtgatcaactcaaccttcatctcctctcccctcccaggagttttgaggatggagatgaaattcccaaccttctaatcctgtctggttttctggtgaccagcttccatccagaagctacctaggggcagccagctaacagtcatctcattagcatataaaagatactttgatcacttcagaggctattccaagggttgcaggagcttcttgccaggagacaggacaaaaaccaaatatatatttcacaatatcaaaccaggtgacattactccagataaaattgactctggattggtaaacaaactgcatctggactggaggactgagtaaactatgactggctggtaggaagccatggattggggttttctgagcacattgccactcagtgataagtaactgggcccatcttttgctgggatcctcgaagccatgccactgggaccattacaagagatactggtctatggaacaggttagggcttccaagcaacatcatcctagcactcagcagtgtggttttgttccccagcaccggagctatcacgagggaggggcagattgggctaacagctcctggattgctctgagaagccctcctgctggagaagcctgcctgtccccaccctctggcacgctggctttcctgcccctctcctgcacagctgggtaaactggtgccactgtggctgatttgggccttatgggtgcagcgagtggcttgaattgaaggccaccaagtgtgggcgtgacaggatgggatctggagcagaaacaggcgggttattagtctttgcaaggaattggggcgcttgtagaagtgagttcttgtttggtggtgacaaggccaagcacagacctttccccttttgcttcagtcagctgcccaggccacaaacctctggcttcctgttctttgtttcatgattgattagctatgtttagaactgtttgttgtagctctgtgtcccctgtgaaggctgctctgtcagccccaggcaggattgacttcctcctttgtggaccacccggaccccttcctacatctgtcactgtccctgtgaggcaggcttcctccctgcctctgtttcatctatgagtgtcttgagtgtcttaagtgtcacttttctccctccactaaactgaagctccttgagttcaagaggtgtggttttgtatcaatctttacttcacaggacttaccagcccggcctctgttcagtaaacatgtgttgaatgaatgaatttccagggtaaaatatttctcataccctatctgtttctcctataaagttcaaaatgattttagtcatatagatactctatgtaatatactatgccaaactgactagtgactggcataagaacaattatatgagaaaggccaggccgggcgcgatggctcacgcctgtaatcccagcactttggaaggctaaggcgggcagatcacaaggtcaggagttcgagaccagcctggccaatatggtgaaactccgtctgtactaacaatacaaaaattagccgggcgtggtggcgggctcctgtagtcccagctactcgggaggctgaggcaggagaatcgcttgaacccgggaggcagaggttgcaatgagccaagattatgccactgcactccagcctgggcgacagagcaagactcggtctc

SEQ ID NO: 859 - DNA, 2880 bp, Homo sapiens
gtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcaggtctgcgcctccccggccctgcgcccgcgcccagagcgccgggactcgagcctggcacccccggctggatccccaccccgaggactcggggagccaccaccctacccccaccaccacccagggcggccagggcgcgcgtctggaaagaaggaagggaaacgcaagagccaggcttagtctaacttagtctggtctgaggacgcttatttcccttctctggttcccatggcccgcgaaatcaagtcctagaggcgctttattctcaggactgggaatcagtttgggggagggaggaggacacccggttcctggggacgtttgaaggaagggcgagggatggagaaagggggtcgagtaactcaagtgttagaagttcgttgacttttgactggggagaaaggaaccttaaacttggggaggagaagggagtcctggagttgttacctaagaacaaagatggggcggaatggaggctacagcccgaaagccaggccagcagtggcgttcttctgtgtccccaagtagtggacttgagcccgctgagacctcggcaggagtctcgtcccagggcaggtgggtgtgcggggtgagccgcggagcggttccagctcgggtaaagaggaagttacctcgggtcctttgcactccaactcggcggcgccccgagcccgaggggccccagccaacccgacgcccgtgtgttgtgtgtgtctaacacccggtccgtgccggccgcccgcgcccgcccgccgctgcccccagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataaggtactgatggctcgtgtggtttttaggtttaactgcaacccagacatctttcagcttccaatgcctcctggttcgtttggtataacgactgcaccttcacttcaccctctgctatttatatcttgccttaagtgctttcccttggtcctttatgctcctttgttttcccttcataaatgctctttgggcagccaaaaaaggagccaaattatcgcacttcaaagttgttggatttggtcaccctgccttctgctgttgcgaggttggggggcagtgttcctggaaaaactaaacattttaatacctgatgatttggctactttaaggcagcccttcgtctctaggactcagttttcattttttcccatccctctcctttttctctcctccttcctttggcttgtctcccaccctttctgcctctgatcgaaaacattagcaaatgtgccgagcttgaagaagaattgaaaactgtgacgaacaacttgaagtcactggaggctcaggctgagaaggtaggccaggaggatggtgtgggggaaaggcatcttttaagagctgctcaaaagaggccctgccagaaagcaacacttacagtagacattttagtaaaatggcaatattgtgaggtgatttttggagagttactagataacaaattcttttttttaactagagaatttattttatgttagggatatgaggcatcaatttaatttaaaccaagtgccaagtggataagttatcttgttgttatcccatgtaaaacaataggcaagaaagcagagaatgtattgcagtgtgccatttgatatcagaggttccattacctcctaagagatccttaacatctgttggctgagctggcgagttctttgcatgagaagccatgagtagattgagctgcagcctgacatctggaatgctctttctaattacagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgttttgtttttaaacacctgcttaccccttaaatgcaatttatttacttttaccactgtcacagaaacatccacaagataccagctaggtcagggggtggggaaaacacattgtaggacattttct

SEQ ID NO: 860 - DNA, 3472 bp, Homo sapiens
gaagtccaaactgtcgtcggggctggtgccgcgcgctgccgctgggcacccgcttcgcttcccgcgtcctgcctgactgcccgggtccccgcgggccttgggtcgctttcaggagtttagagaaagccaggtcttcacgttcgtgtaggttcgagaccttaacgaactgcagagcgcaacaaagggaactagagccccggcgccttcgcagccggagcggaagccggagttgtgggaggcccgcgtgccctccccgcccgtggggcccagacgcgcggggacaacccctcccctccacgcatcccgagtctctctctccctcccttgtcctagccatggaagggctggaggaggcagaggccaactgctccgtggcgttcgctgaggctcagagatgggtggaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattgggttgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgccttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctgtctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggggacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccac

SEQ ID NO: 861 - DNA, 2391 bp, Homo sapiens
ttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctccaagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccggctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaaccccccccacccctcccccgccgtgtgtggctcctcgccgcatcgttggggttttgttatgtgaaaatatcctggaaataaatacatgtttctgcacttag

SEQ ID NO: 862 - DNA, 2293 bp, Homo sapiens
agtgcctttcacctcccaccatgaacctgaggcctcccgagtcatgtggaaatatgagcaaactgaggcacaagagaggtctaagtacctgcccatcctcacagagtgattcaacatctacagttgaggagaggggagagacgggaagaaagggccttggctttgaggctactctttgtggtttatgaaccacactgagtgaccctggggtctccgatggcgagtccaagctgtacaggagccagagaggtaccatgtgccggagtgacaggatcagaatctgtgacacatgcatcataatccctgtcccgaaggcatacgctttttcaaatgatgggagaccatgaacagtatattctagccagagttcctggctgggaacctgctcctctcaggagctctgcagctgggttccttccttccttgggtgggcgtcctgcagcttcttgtttaatatctggaccccatccaggcctgctgccatggcagagctggccaggccaagccaccctttgggatctgcataggattttatttaccccaggagatgggagggagaaatgagggagaaaatagcaatagtgacatctggagcctgcatctgatgagttcccagaaatgcagggatttgtttacaaatgcgagactttccatctgaggacctgaggatgtttgaaaaactctacagctcacctgtaggctagaaatcctgtccccaaactgcaggccaaagaagcggtcccacaaatggcccacactgcagagctccaccaaggctgaagggcccttgaccactggggcattagtccctccaaaccactgctgggtgctgcggaagagtaggacagagacaaggcagcttaagagacctcggcatctccatccacgcggagtgtggtggtgaatcttaggtgtcaactaggctgggtcgtagggtgcccaggcatttggttaaatgtgatttttgagtgtgttcggggttgggggtgtttccaggtggcattaagatctgaatcagcagactgagtgaagcagagggccttcctagccacaggcctcctccaatcccttgaggtcctgaatagaacgcacaggctgagaacaggggaactcctgcccgactgctgagctgggacattggtgctcacctaagggtctggggtcaggatgggggtggtgagcagcaactcctgccttgctgtgccctcagaaggcttttgggggtctcctcttctgacctgcatagggacctatgggtccccaacatcagaggcagagaggtcagtttccatttcagaccccaaacaactaagcaggctgacctggaatctgagggtctgccctgatttggatcaagtcccacacaccacaagggacagggctgtgactggtcccctgcagttttcaaccttccctctctgctgtgtgatttccccagggccagatacaggaccagaaggttgccccatacagctcttcatacctctgggtgcagccgtcttagctcgttttctagcaactgctcttagaggcaggatgccatgtcaacctagggcaatcgagtacaacacctttcaacaactaagaagctcttgctgggaagctggtattaggcaaaccgagggacactggctgaacataaatcaaagaatgtgagctgtggccgggacagtggcgttgtcctaagccacaccttctccacaacctcatcggtggctggtctgccagtgtcagccttgcactcctgagtgctcccttccagcccaggccacgtgtccagtttgtctgggagggtcgtcggtccttgggatgagtttcccttctgatctactgctgatacttgtgcctacactgaaggctcacctgcctgaagcttgttcactcacagaaaggatcttttttgtgccccactgtgtgtaaggtgctgtgcagcctgggcccaaccaaacatagctgcacgcacaggccttgccagtcactgtgaacaagcacctgaatccagcacacaaggacctgggctgagctggagcctcgagaaaaccatctgctcatgtaccatgtggctctaggatcccaaagccacacatccctgccaggccaggcccaccacagtctcctctttgccatcatttggccaccctcctaggattgcagcaggattcaatcaccctgggcacagccctggttgttctagggtaatccctgcctctaccagctcattgctgagattccagcataattggaagctgggactatcgttcactgtcattagcattaaaacatgcaaagcttc

SEQ ID NO: 863 - DNA, 3215 bp, Homo sapiens
aaaatacgagcgggaactgcgttgagcgctggattccaggccgagtgctggcgaggcgcgcagttctctgctgtttaaaaagtatccctgtgctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctaggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgag

SEQ ID NO: 864 - DNA, 3685 bp, Homo sapiens
atctgccagaacaccccgaggtcatacaagtgcatctgcaagtctggctacacaggggacggcaaacactgcaaagacgtggatgagtgcgagcgagaggataatgcaggttgtgtgcatgactgtgtcaacatccctggcaattaccggtgtacctgctatgatggattccacctggcacatgacggacacaactgcctggatgtggacgagtgtgccgagggcaacggcggctgtcagcagagctgtgtcaacatgatgggcagctatgagtgccactgccgggaaggcttcttcctcagcgacaaccagcatacctgtatccagcggccagaagaaggaatgaattgcatgaacaagaaccacggctgtgcccacatttgccgggagacacccaaggggggtattgcctgtgaatgccgtcctggctttgagcttaccaagaaccaacgggactgtaaattgacatgcaactatggtaacggcggctgccagcacacgtgtgatgacacagagcagggtccccggtgcggctgccatatcaagtttgtgctccataccgacgggaagacatgcatcggggaaaggcggctagagcagcacatccccactcaagccgtttctaatgagacctgtgctgtcaacaacgggggctgtgacagtaagtgccatgatgcagcgactggtgtccactgcacctgccctgtgggcttcatgctgcagccagacaggaagacgtgcaaagatatagatgagtgccgcttaaacaacgggggctgtgaccatatttgccgcaacacagtgggcagcttcgaatgcagttgcaagaaaggctataagcttctcatcaatgagaggaactgccaggatatagacgagtgttcctttgatcgaacctgtgaccacatatgtgtcaacacaccaggaagcttccagtgtctctgccatcgtggctacctgttgtatggtatcacccactgtggggatgtggatgaatgcagcatcaaccggggaggttgccgctttggctgcatcaacactcctggcagctaccagtgtacctgcccagcaggccagggtcggctgcactggaatggcaaagattgcacagagccactgaagtgtcagggcagtcctggggcctcgaaagccatgctcagctgcaaccggtctggcaagaaggacacctgtgccctgacctgtccctccagggcccgatttttgccagagtctgagaatggcttcacggtgagctgtgggacccccagccccagggctgctccagcccgagctggccacaatgggaacagcaccaactccaaccactgccatgaggctgcagtgctgtccattaaacaacggtcccccttcaagatcaaggatgccaaatgccgtttgcacctgcgaaacaaaggcaaaacagaggaggctggcagaatcacagggccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtgtcagctgcccgcagggaacgtattaccacggccagacggagcagtgtgtgccatgcccagcgggcaccttccaggagagagaagggcagctctcctgcgacctttgccctgggagtgatgcccacgggcctcttggagccaccaacgtcaccacgtgtgcaggtcagtgcccacctggccaacactctgtagatgggttcaagccctgtcagccatgcccacgtggcacctaccaacctgaagcaggacggaccctatgcttcccttgtggtgggggcctcaccaccaagcatgaaggggccatttccttccaagactgtgacaccaaagtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagaatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactcatccccatcctccattaccacttatgagacctgccagacctacgagcgtcccattgccttcactgcccgttccaggaagctctggatcaacttcaagacaagcgaggccaacagcgcccgtggcttccagattccctatgttacctatgatgaggactatgagcagctggtagaagacattgtgcgagatggccggctctatgcctctgaaaaccaccaggagattttaaaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgcc

SEQ ID NO: 865 - DNA, 3314 bp, Homo sapiens
gttagtttggaaagaatagaagaaggaatagatgttcaccaagaccagtagttctcaaacaggtcgagttgtttccttgatgaatcccaatgtgtctaccgagatgttccagttgaagatctagtaattaaaggtctctttacaccagagctaagatcacgaataaaggagcagctttgggtttgcagagattacacaggaatgtatgtttctggcaggtcatttgccatctttgcaaggagtgtacatggatgtcatcattacaaaggatgtgagaggaaaaatttattcaagaagcacttattaaaatttcttccactgtgctggatccttaatttacatacttgtttgtagattctgtttctctttaagtattttttaaaaattcatatggaatatttcttataatcccaagtttattgttgttatggtcaaccactaattacttgaagaatgtaatataaaattgtttatcgtttatgaagtctcttagttaccttttgatacagtttggctgtgtactcacccaagtctcatcttgaattgtagctctcataatccccacgtgttgtgggagggacctgatgggaggtaattgaattatatgggtgggttttcctatgttcttgtgatagtgaataagtctcatgagatctgatggttttataaagggcagttcccctgcacatactctcttgcttgccgccatgtaaatgtgcctttgttcctccttcaccttctgggatgattatggggcctccttagccatggggactgtgccattaagcctctttttctttataaattacccagccttgggtatttcttcatagcagtataaaaatggattaatacagtaaattggtactggtagagtggggtactgctattaagatatctgaaaatgtggaagcaacattggaactgggtaacaggcagaggttagaacaatttggagggctcagaagaagacaggaagatgtgggaaagtttggaacttcctagagacttgttgaattgctttcactataatgctgatagtaatatggacaataaaatccaggctaaggtggtctcagattgagatgaggaatttgttggaaactggagtaaaggtcactcttgctatgcaaagagatgtactgcattttacccccaccctagagatctgtggaactttgaacttgagagagatgatttagggtatctggtagaagaaatttctaagcagcaaagtgttcaagaagtaacagtgcataaaagtttggaaaatatgcagcttgacaatgtggtagaacaaaaagcccattttctggggagaaattcaagccactgcagaaatttgcacaagtaatgaggaaccaaagggtaatccccaagacaatgggtaaaatgtctccagggcatatgagagaccttcacagcagcccctcccatcacaggctcagggacctgggaggaaaaaatggttttgtgggcctagttcagggcttccttcctgtgtgcagcctagggacttggtgccctgtgtcccaaatgctccagtcatggctaaaagtgaccaaagtacagctcaggtcattgcttcagaaagtgcgagtcccaaagtcttgacagcttccacatggtgttggttctgtgagtgcacagaagttgagaactgagttttgggaacctctgcctagttttcagaggatgtatggaaatacctggatgtcgaggcagaggtgtgctgcaggggtggagccctcatggagaacctctgctagggcagtgcagaagggaaatgtagggtgggagcctccacacagtgtccctattggggtacttccttgtggagctgtgagaagaaggccaccatcctccagatcccggaatggtagatccattgaaagcttgaactgtgcacctaaagaagccacagacactcaatgccagcccaggaaagcggccaggagggaggctgtaccctgcaaagccacaggggcagagctgtccgtggctgtgggagcccacctcctgtatcagcatgacctggatgtgaaacatggagtcaaaggagatcattttggagctttaagatttgactgccccactggattttggacttgcatgggtcctgcagcccctttgttttaattaatttctcctgtttagaatggctgtatttacccaatgcctgtacccctattttatctaggaagtaactaacttgctcttgatttaacaggctcatcggcagaaggaacttgccttgtctcagatgagactttggatatagacttttgagtaaatgctgaaatgagataacactttgggggactgttgggaaggcatggttggttttgaaatgtgaggacatgagatgtgggaggggctgggggtggaatgatatggtttgactgtgtcccaacccaaatctcatcttgaattgtagctcccacagttcccatgtatcctaggagggacccgatgggaggtaattgaatcataggggtgggttttcccctcctgtcctcatgatactgaataagtctcatgagacctgatggttttataaagagtagttcctctaaacatgttctcttccctgccaccatgtaagatgtgcctttgctactccttcaccttctgtgataattttgaggcctccctagccatggggactgtgagtccattaaacctctttttctctataaattacccagtcttgggtatttcttcataggagtaaaaaaatagactaatacactctttatctttcagacttttctatatttttataactttttgtgagacttcataaaagtttagaaaatgcattagttaattgtgttattgctaaaagtgaaagccatctagcattcttattcacatatggcctagtttttcaagagtttttcagaacttaggttggctagaaaatcaccagtcttttctcattatattgtagaaatttcatcagtgagtattatcagatgttgtgtaagaccttacaaagaccccacagaagtaaaggcaataatcctatatgtaaaaaaacaaattgataacaaaaacaaaaaacaaaacaaaacaaactaaaaagtactgaaacttcaagaaatgtttttccaataattgaaaataaatagctgtttggatgaatataaaaataaatctcaataaattaaattcagctgccatttttgaataattaattggtatatgttggattatgtgtgcatattgtgtaacaatgatactggctgtaagatagctcatattgggttctttttctgctacctataatagatttgtgagtgtcttacaac

SEQ ID NO: 866 - DNA, 2337 bp, Homo sapiens
ccgggacccgcagttccagggtcttttccaatacctgctgcgccccaaggccagtggcgccactgagaggtacggggccctagggccagggggccaccagtggctcagagagcccggccacagccactggggtggggctcactgctcagccctaggctgaggccagggtgctttgtgtcccacacaaggctgcgtccccgtcatcaccattatagaggccctgcttctgcaccacgggtctgccgggggcggggcctggtctcagctctctctgctgcccacatcaaccctcataagcttggaggttggccctgtgggtgctccattttgcagatggacaaaccgagcctgagcccaggaagcaggaggcctgggaccggccacaggcctcctgccctcagcccacgccagcctttgtcccgatggctttactgtcccgggtgtgctgacgccaggggtctccccaaacccaggggagcaggaggtcccgagaggcgatgagtgaggatgggagcgggctcagctgtgcgagagggagcagtggcgacgtggccccggcctgcagtcaccaggtcgtggagcgggcagcactcacggccacactgtgtcctcaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacaggtaggtccctcctgcgctcctgccacagccctgggcgggtgcctcctggactcctccccctctcccctcccccctccccttcagtggcttcggcaccacccctagctgggccctcagcagcctcagaccctgccacccccacccacagccccacacccagccccaggcacttctctctgcttctcaagaacattcccgtccttctttctgccgagcctgtcctcttcagggttagctcaggtccctcttccccgtcttgtcccctggggtccttctctccaaaggcctgatgcatgcaggcccatcctggttccactctgagcctgggcctgaggccagcgctggtgccagccttctccccagtgagaacagtttctctgaggctggcagtcttctgtgttcctctatcggagggtgcagcatacacctaccactcagacgcttcccgggtttctccaggcccttggcctggatggggatggggtcataggtctgcacagagcaggcgtagacccggctttctgggcagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctccttt

SEQ ID NO: 867 - DNA, 3308 bp, Homo sapiens
ggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaagaaataaaggcagagaaagaggctaaaactcaggctatacttttggagatggtgggagacctacctgatgcagatattaaacctccagaaaatgtactgtttgtgtgtaaattgaacccagtgaccacagatgaggatctggaaataatattctctagatttgggccaataagaagttgtgaagttatccgagactggaagacaggagagtccctctgttacgcttttattgaatttgaaaaggaagaagattgtgagaaagcattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggagtatccttaccaagaatcagttagttaatatgtattgaccatctgctatgtgtagagtactgtgtgatgtgttatgaaaagtcacaaaagctatagaagacaaatttcctgaatccagattgtttgtgaggaagtaacttagtttatcattatcccttttcaagatcttacatatactttgctttttcactatactctagtgtatggagaaagttaaggttgaaagaaatctgtagcctaattcttttattaatactttcctactctaggttaagtactttcctacttatcatattctcagaagatcttcaggtaagatttgtattttctttttgggggggctttcctgcaaaaaccggaaagcctactagacaaattctaaaagagctgtaacactagctttgtattttctatatgtaattgtaatgttttctattcctcataatctgaaatttattattgctaagctgattcctttgtgctacctgctgttatgtttaacttccttacctagataacaaaatcctattgttctctgttacaatgttaggttacttctttcggtatagtatattgtaatttcaacaacaaatatttattgggcttctactgagtgcaagagttcacttttgtaggattaaaaagaaatccattgacttgaccatttacttcaggttcttccaagttttaggttgagacatgtaaaaagtaatgaaacatactgtttatattatgacatttaaattggttcactaatttttcccattataaatatatcactccacacattgcaagagttatttctgttgtgattctttctggtaaatggtgtctttgtttcctagtttctattggtatttcagggattttttttttctacatatgtagacatttcttttccaagtactcatcaagaaagatgaatatcaggttgacctggtctatattcatgttttaagatgtgttgattgtctgcaatgtataaagcattgtgaggtgttagaactggataaagtctgaagaaagctgataaaatcagcataaggagaggctttcacatgcagacagaccaaataagaagctgagatttggtcagaaaagatcaacattcaagggcatatgattgaaagctcaaaatcataaaagttatgaatggaatacatttgatatttatttaccaaatctttgaaattaaatttaggcttattactaataactatagctggaagaaggggaattttaagttttctttaattttaattaattgaaacaaccacacatatacttatatggaatagtgtagcttctagccttttgaagttgatgcaaaagagagaaatgctgttaggggatagtctgatgtgcagataaattgtcttaagtcagttaagaaggcatggtggcatctactttatgggccttaagagaaagagaaattagtgaaagtatagattattaataagaagaatcaaaaatagaagtaggagaaggaaataacttggcccaactagacctcagggaagaaattggagaaaagatggcagtgagctcacaaatttgtgttttattcaaagggagagggatttgatgtcttctgaaagtgttgattttagtgataagtacaagatagtgggtaagtgaggaagcaggagatacaacaagtgtcttgagggtatgacaagtaatcaacagatacttagtaagcatctgtcacatactcagtttagcaatgaaagatattcagttcctgcccacatagagcttacattttgctgttggagtggggaaaaaaaaccagacattaaataattaccattctaaatacgtctaaattattgcaaataaatattgcaaagagatatgggactcataatagggggcgagaggttagagaataccctcaacactgaaaaaagtggcattaaagctgtgacactaatatgggagataggagggctgaggtggagtgctgtcttctttcgtatgatccatcatttaagaaataggctgggtgcagtggctcatgggagtgctgtcttctttcgtatgatccatcatttaagaaataggctgggtgcagtggctcatgcctgtaatcccagcagtgtgggaggccgaggtgggaggattgctggagcccagaagtttgagagcagccagggcaatatagcgagacccggtctccattttttttttctt

SEQ ID NO: 868 - DNA, 2015 bp, Homo sapiens
ggtcaggccaggtcgccgcctgagcagaggctgcagcctgggcagtcccgggcttctgaggaggaactctagcagacagggcctggatacctcttgagatgcagagagatggctccgatctggtccccacctggcagggtctccggctgtcacctgagttcaggaccagcaccaggatctgcagtgggcccctggctgggcacacctcaacccagcctccccctacccctggccccccataagcctcctcctcctgggcttccaggctctgctggtcagacctccctccctgcccaacgggaatgtgttttcccaggggacgctgctgtccaccaggagctctgtggcctgggatttgaggagtgcctggggtcaatcccccaggctcaccagtgctacttaacaaatgggcccaagagaaggaagtgcagcccccggaggaggggcagagcccctgcctggctgtgcggtggctcacccccttgtcaccaggggctcggccatgagcatccgtccagcgggcccagcaccaactgcagccccaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcaccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagatgacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctc

SEQ ID NO: 869 - DNA, 1782 bp, Homo sapiens
ggcctttttttttttttttttttttttgagatggagtcttgctctttttgcccaggctggagtgcaatggtgtgatctcagctcactgcaaccttcgcctccctggttgaagcgattctcctgcctcagcctcccaagtagctgagattacaggcacacgccatcacacccggctaatttttgtatttttagtacgtatggggtttcaccatgttggccaggctggtcttgaactcctgacctcatgatccgcccacctcccaaaatgctgggattacaggcgtgagccaccgtgcctggctgcaggaggctttgatgccggcctggcagccagctccaggagttgggcgacggagggggcggggagagcttcgtgggtggccacggccagcagcacccgggtgcccctcagagaggaaggtacctgcagcctctgctcatgtgtggggccagcccccacgcgtcccctcgtcagccgcttgctatccttgcagctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctacggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgtcccctgtgagcccgagtccgcttcaggaggggagcctgcaggtgccggctggtgaggggatgacgcactgtgggtgggaggaggcagcgcccatctcagcagcaccaggactgcctgggactccctggcaacccagcaccggggaagccgtcagctgctgtgacaataaaacctgccccgtgtctgg

SEQ ID NO: 870 - DNA, 2022 bp, Homo sapiens
ataaaattcggtgtcccttcatgttaaaaactctgaataaactaggtattggaggaacctacctcaaaataataagaaccatatgtaataaacccacagctgatgtcatggtgaatgggcaaaagctggaagcattcccctggaaaaccagcacaagacaaggatgccctctctcaccactcctgttcatcatagcattggaagttctggccagggcaatcaggcaagagaaagaaataaatggcattatttttaaattggaataatcacctttacctctttttaccaaaatgttaaggctgaagtatttttagcatctcaggacagttactctcatcatatatcaaactaaatctcctagaagcaatctatccacatccatatcagttcaatctcagaaatcagtatctcaatgggtactgtgtacccaaatcatctgctagaataaaacctctctctgtgacgggaacagtccaaaaaggaagctgggagtcagcccatcacgaggttgcttgatcagaatcacatgaactggaaattccctgtctccccttaaccagcactggaagcagatgggaagagaatagctgtgactgactcacactctaacccagcaaccctcagcatacaagtgggagaccataaagtttttcaagaccccaaaagaggccaaaggtctgataattgctgggagaaggtccactatccaagaagagaagaggaaaaggaattaaagtctccaagcactggggatgcaagaagagagttgcacaggagagaaagaagaagttgtccacggggtgaccctgcaattggagggaaatgcatgtggatatgtgcagggagtctaggaagtgaagccttagtgatcatttacaagaatgagggttaggtaaaataagggatgcaaagccacctgtagtctattctaacctcactccatcactctatacaatctgtgttttatcatctgaaatgttaagtaaagacctgtttgggtcttcttcagaatcccatacatttgagttcattagtcagaaaaagggaaaataccaccaccccatcctggaatggcagtcatgtacacttttataatgagagattgggcagcaaagggggccccttgtggacctcacccagccagagaaggaggcagaatgtttcctttactatcttttcctctccccagaggaacactacatattgttccctccatgggcttaagagaaggtgccagggttacagatagatatatcgctagctgtagagcacagggtgaattgggatgtccatgtacaaagctagggacaggagaatcagtttaaagactttaaaaataattaggaaaaaaaggaaggcctgacccaaagcttaggagtgcaggtagagaagagatggtgccatgatataccatgtctctgggacttttctgtattcctcttcctctgtatactgtattgccctcattccctatttattcaaaatctgtgctacctccactgcgaagacttccacgagaaaattcagatatttcttcttttgtggacactttctaccttacaaataagttaattttaattcaaggaagagtttttccggaaccctgttggcctgctcacaggaatgtaagttccttaaatctagggcacagtgtctttgagaactgcaatcacctacatcaacatgacatagctattaggactacaggcgcctgccaccacgcctggctaattttttgtatttttagtagagatggggtttcaccgtgttagccaggatggtctcaatctcctgacctcgtgatccacccgtctcagcctcccaaagtgctaggattacaggcctgagacaccgcgcccgccacccccccctcttttctttaactggcctaactaaatatttagtcttttcaagtttacctcaaacctctcacgtgtgaaagctctactggttagccctagagttaattatattgtattgcttggctcataggaggtatttaataaacacattagttgactg

SEQ ID NO: 871 - DNA, 1718 bp, Homo sapiens
ttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacgtgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgt

SEQ ID NO: 872 - DNA, 2432 bp, Homo sapiens
tacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatggggagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaacagttcagggtctacctcggccttcctcttggaaaccactggagtggagctagaattggaaagaataacatggccaccatcaccatatccaatgatgaagatgcccccaccattgagtttgaagaagctgcataccaagtccgggaacccgcaggcccagatgccattgcgattctgaacatcaaggtgatccgcagaggggatcagaacaggacctccaaggttcgctgcagcacgcgggatggctctgcccagtctggtgtggattattacccaaagagccgagtcttgaagttcagtcccggtgtggatcatatcttttttaaagttgagatcctgtccaatgaagaccgggaatggcatgaatctttctcactagtccttggcccagatgacccagtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacaggtcaggcaggtggtgccttccaccacacatagattgaagtgaatctcaggtctcctttgtgtgtttcccaggacaatcaataagggatgcttctgcatgataaaaatgtgatgatgaatgcatcagtaaaagtttaaatctgtgaaggtccctcaagctcgggccccctgcctatcttcctagtctttctctcaccttgtcattttcaccggccattccaaccacaaggaatcatgagtaacttcccaagtgctacagactcttacaggttgcatatctctgccatgctgttacctcaactctccctaacccccttccactggccggaaccctactgtcctacaatacctactgcatggcatctcttctagggacatttccaacatctcccctaatttaatttggaggcttcccctcctggcttctctggcacctgtatatgcttcttttagaagattattagcattcactctctctgccctttagtagatggtaaggcctgaagaccatgagtatgtattttgagtatcttctgccagtatagtgcttcttggcatctaagaggcactcctaaatatctactgaacaaatgaataataacattgtagaaattaggagacattggacttaatttttttctgggccaccatgatgggaaatggatgttttcatttttgcatagcaaaaaagaatttgtgtatgttatgcgtatttattaaacactatagtatttaagtgtgtgcctttatgaacaactcagttgctcataaactcagaaaaatgagttcctttgtatgaataaaacatgtttgaatg

SEQ ID NO: 873 - DNA, 3006 bp, Homo sapiens
agatggacatctaccagaagcggtgcgaggccttcgggtatgtacgaggctgtggcctgagtgtggtcacagcacgggagagtggtctgtgatcacagctttgcaggtgcaggtgcaggagctgaagctgggaccttaagcaccatctaaaggtccctttctttagcatttgactcacaatttcaaactctaggcatttggacttaatggctcaggatatgtgggccaggcccagttttaagtgagtttccttgttttcgtggttgtggcatggtggctctcggagcttccacacaccatctcacgtcagctcgctttgttcttgaggaaggagggttcttgagggatgggggcttgctcggtaaagctaaaggatgtatagctgcggagaggtttgaacctcagtttggtggccacgtcctgtgcccagccccgcccagcctggggaggaggaacaggctcctggtgaaatgggagatagggtttccagatgccccccttcggccttggttggttacaaattcagggtcaaagggcacaaagcagggaggtcaatctgcatgggtgtcagccagaggggctccacctcaaagcctccaccggtgtcgccaaacacaagctgctctgcacaggggcccagcattggctgaggaggctgtggaggggagggagcagggcaggtgccgtgcaaggctttgagactcaggtcaggcctccaggactgcgttttgcagatgaacccatgcctgtgactacactaagtaacaggatgcttggggttaccttgcagtagcacagcagacgcaggcctgtgttccctgatgactgacctcagaaagggagaggaggaagggaggaaataatctctgttggacaggcgaggaaactgagccacagggtcctcaccccacaggcctccccaaggccacatctatctggggactcagagtacaaccccagcagcacccccaggacctgtgtccataacctcgtgactcaagccagattcctgaagtcctggctccaccgctaacttgctttgtggcgtgggtcacgttacttactccaccttcagtgtctcagttgatttgtctgtacaatggggccagctcagcacccaagcatggcgtggtgaggcttcagtgggctaatatgggtagtggttggcatggcactcagtttgagaagtgctatttttattcttatgtcaaaaagagtccccaaaaggatagcttttcaagagaaagggtgctctgccccagctccttcctgtatatttgactccatggttcatttcaaaaacatttccagcaccacatccagcatctgtggagtgatcaaatgtgttccccaaataagaattgggccaaaaaattcatcaagaatctaatagcagacagattccaaacccagtgcgctgaccccagaacagctttcagtaggaaatgagcagatcaggaatgaaagagacaataaaggaactgagctctggattacttaagaagaggaggaaaacctgttcagaggcaaacaaaaggaagtaaaataatgtgaaaaagaaaaggatttaaaaacccaaactggaaacaggaatgttgcaagctttctactactccagctgaggccgcagttgtggggtggagcctgggcagaccccagctgccaaggcagacctttccctggaaggctccttggtgttgtggcccctgggaattgccccttactctctgccccctgttcccagttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagccttcccactctcttcctcacagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgccgagcagaacatggtgagcatcgcggtgggctgtgccacccgcaacaggacggcgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccagctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgag

SEQ ID NO: 874 - DNA, 2029 bp, Homo sapiens
ctcagtcatgtgaccggcaatggcggcgctgacgagagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtctatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactc

SEQ ID NO: 875 - DNA, 2586 bp, Homo sapiens
gttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatattgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaagtaagagacacactggttttctgcaccttagacattctgactttggaagaatttttgaattcctaattactcatttgactttttttttttttttttttttgacatggagtctcactctttcgcccaggctggagtgtggtggcgcaatctctgctcactgcagcctccacctcccgggttcaagtgattctcccatctcagcctcctgagtagctgggattacaggcgtatgccaccacacccagctaatttttgtattttttagtagagacagggtttcaccatgttggccagggtggtctcaaacccctgaccttaagtgatccgcctgcctcggcctcccaaagtgctgggattacaggcataagccatcacgcccagccaatattttcaaggctgtgcaaccatcaccacaatctaattttagaacattttcatcccccctaaaagaaaccccatacttactagcattcgcttcgcatttccctcttcccccagccctaagcaactgctaatctttctttccctatcaatttgtccattctggatgtctcatataaatggaatcatgcaacttgt

SEQ ID NO: 876 - DNA, 3063 bp, Homo sapiens
ggccggcttccggcccggcgaggtttgagcgcgtccgcgggctgggaggccgctggacccgggcgcatggcctcccccgggcagttatctccttgccgcgaccttgaggtcttcggtaagaactggcgttcctctttctaacgccggctttcggccttcgcccttgacgcccaggcccggggaggccgtcactcagaaactgctccatccgagtccgccgcctcggagatgccgagagcctggtcctgccctctgcccccggccccttcctagactcactacttcaggtcactaaaggcgcctcccaccagtttgacttctgttctgcctctgcgccccgctctggcctctcctaagccgcttccctggccatgtctttagagttcgctccccgccacccctcgggcgcccgccttctgtgcgacccttccccccacttcctggttgggctcctggatcccaggacgtacctgcagcagcagcttgacccgctcgatgggcgctaccgccgtcttggagatggctgcggccactccacctgccaggaagtccttggcgaaggacacagcggcatctgtcatgttgaaagaggaggcagactgctgcaggacgggactgggccgggaaccggctttgactccggcgctgcggggcggagcgaagcaaatggccgatttatatagggggagccggagctggagcggcaggcgtcggaggcggggccggggcggggtctgggccccggcgcgctgggcggcagagccgctgagtggcccagctcgcaggaggaggagtcgtggagggcgggccgggactgctctccgcgccgcccgtgctcgccctcggcacctgacccggcgagaggaaggggcgggtccagagaacacccgggacttgaacgctggaccctgagagaggcctcggagaggggaggaagggtgaggtcacgatgtgcctggacaaaaacccttggagcaggaccaggactagggtgagacgcatttgctacagggatgccaaaagaacccttcagtcatcgagataaacagtagtcaatgcgatactttaaaaaagtcgtatgggcaaactacatcctactggccggcccccttgttttgtaaataaagtttaattggagtgtcaaggctgggtttagggtgaggcaagcgagacaaggtcatgcaagtgcaggttgggatcctgtctgtatttcaaatgttgatcatttgttcatcatggatttttgcattgcttctgatttttttaaaatagtacatgaaaaatcatttgtcttaattactgagttgtttttcaccaaggtgaatgcctcactcttcccactctagaccgtgtgctgtcctggagccagtgaaaccagacgaaattaagggaacagcagacgaaggaactgccaccgtgccccagaccctggtttgcaaatacagttcgacaaagatcttgccaggaattggcctgggagagtccaaaggactgggctgggggtggggaaatgattttagccagaagacaaatatagaggttgtacccagaaggttaagaggcttaggaaggttaagaactacgttaacatttggctcccaggaccccaggtaaagtgcccttggattgaatagatttctgaactccagaaacatttagaggaatcaatagaattagattggcagccattgtgccaatggacaagtgcttactgagccccttaatcccttcactgggtaagcatttgccacacatgtcctcaaaaacctacttgttagcttaagtggactccctcaagttcagaacaggagcaaatagtgtaatcacaagttccgtgtctgaataatcataacaatgtttataaaaataaggacgactgttgaaaactgcaactgcagctgaaccttatgtgcccagacttcagaattcccataggcaaaatgccagcaggcctttgcacactgaacacatagtgttcatatccttcactttcctttcctgccctctcctatcttctccagatctgcctgtgaaaggacccaattctaggaccccccaggatggttaggcccttcctctgaaagtacactttgcaatttgttagtctcctcaagaaccccggcgatcgaaactgatgcacacaaattgcatgtgttcaaaggagcaattttgaatctagctttgttgatcctgggagaaatctttgacctgtgttagtgaaaggctatggtgtttctcagctgattataatagcgaggtagctgaatgcaaaaaaacagtttcagagaatggtagagtatatcctccaaaggtgatactcgcttctctattctggtgagagaaacaagagctaaagcaaaattctacagagggctttatttggagagaggtggattttatttataatgcatttaaaattcaaaatctttctagtttgaactcttgacattctgattaatgcatttttattcaactgttaattattcctcgatacacctcgccatcacttgtgtatcccttttctacatgtgacctttccctggccacatctgctactctctttgagcatgatgcctctactgtattctattccagagctcattgttttgtcagttttttttctctccacaaaaaaagatgatcaaataattacatagaatttttcccttctcagtctttgggtaactaagtgtggttttattgacgatgaaatacaagatgggtcatttaaaagcaacttcttgtcatcacttggtattttgctaaatccacggtgagctggagctcccgtagtcacctatcaccgcgtgtattttaaggagtcagatattctcgaaactgttaagatcatgaaagacaaagagactaaggaactgtcacagattaaaggagactaaagatacttgacaactgaatgtaatatatgacactcaaccggctcctgtaccagaaaaaggacattggttatattggtgaggtttgaatatctgtagattaccaatactattcttggttatggtggttatgtaagatttagagaagttgaataaaggatataaggac

SEQ ID NO: 877 - DNA, 2726 bp, Homo sapiens
aaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatggtgaatgacatacagcaaatgctgctcatcagcgtcaaaatagttcaaataattttacgaagaaaaactcagcttctgttgtttatcaggcagatgtacaggataatggtataaatcaaaagagagatgggatggtatctaaaaactcaagtattttcgatgatagaggaggtataaatatttcaggccaaggttcaattacttcagcgcaggtatcacccacgagaaatttttccagagtttcacaggcatttttggatccttcaaaagaagagaaggagacaaatgctgattgggatggaagaccaaccaagagatcaagctatctctgcgaatcaggtaaatatcagcagtaattattgagtaaatcttgcattctatttattctttcaactaacatttactgagtttttgcttcatgttagatatggtgctaagttttaatcattcaaggaaaaatggcacaatttttgctcagggttcttacagtatacttggaaagatagtcatggcccaatatgataagagcaataaaggaagtgggtatgtgtaaaagctgggaaagttatgggaaagagaatgcatagacctatctagggtcatcatagaagcctttataatttagaaagagactgcgttgagacatgaaggatcagaaggaatttcctattttctttttgttatttttattgtttgtactaatgttgacaaccaaaatttgaaaaaaaattaaagtttttgtactcatatccttatacttactgttttctgcttttacagcagcttctctcccacaccacaactttattaaggtatagtggataatttaaaactgtatatattgacggtacagatggtccccaacttgtaatgattcaatttagggtttttcaactttactgtcggtttattggggtattaaatgcattctcagcttacaatatttttgacttacaattggctaatcaagatgtaacaccatcataagacaaggagaatcatatacaacttgatatgtgtatatacagtaaagtgttcaccacaagcaagccaattaacatatcctcacttcatgtagttactatttgtgtgtggtggcagaagaacacttaagagctactctctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgaattggtgatgcgggctcttttttggttccatatgaactttaaagtagttttttccaattctgtgaagaaagtcatcggtagcttgatggggatggcattgaatctataaattaccttgggcagtatggccattttcacgatattgattcttcctacccatgagcatggaatgttcttctatttgtttgtatcctcttttatttccttgagcagcggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgaataacctggatcccttccttacaccttatacaaaaatcaattcaagatggattaaagacttaaacgttagacctaaaaccataaaaaccctagaagaaaacctaggcattaccattcgggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaataaccagaatctacaatgaactcaaacaaatttacaagaaaaaaacaaacaaccccatcaaaaagtgggtgaaggacatgaacagacacttctcaaaagaagacatttatgcagcc

SEQ ID NO: 878 - DNA, 1977 bp, Homo sapiens
ctgctcacgcacggcggcggtcagggccggcggcccttcaagtgcccactggagggctgtggttgggccttcacaacgtcctacaagctcaagcggcacctgcagtcgcacgacaagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagccacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgatacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttccatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttctcagctcatgaccagtcctagaagaggagtcgagacataagccaccttcagaggttcaatggaaactttaaaaccataccaaactcttttttaaaattagaatt

SEQ ID NO: 879 - DNA, 2657 bp, Homo sapiens
atacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcacctaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggaggggtccttacctctgatccacttagagcaataaccactttttaaatgtaaaataaaaagacaaatg

SEQ ID NO: 880 - DNA, 2364 bp, Homo sapiens
agcgaagggcaccatctttggtaaggattggaggaaaacatgggcggagaaaaagtcgacggattaattgagtctatttatctcctccctctcttcggaaaaaagcggaaggtttgggattgggtagcttcttttgaaaagggttctccgagttgcaggatagatccttgtgttttccctgcctgctgcggcccattttcctggaagccggccctctgacggtccttcactgagtgtcagttttcccctcacctctaatccatgttgtacctacgctgtgtggcccaagaaattgttttaaaatcacctaaagctggaaagtgtggctttgccacacgtttgtgcctgaggctagccacttgaagttgtcgacagagactagcgcagtgtggcggagccgcgcttgaaatgaggtttcttcatttcatgtgtgcgacataaatgggcatgcgcgtaccctctcttccatagttgtgaaaatgagtgtattataattataaatgccaaattaggtacaaaagtgactatttcgaattggaaaagaaatgacaaagaactacagccccgcctcccgaggccccgccccaccaagcagcaggtgcgtggcggccagaggtctccccggcaaccgcccgacagccccgcggagtccctggaggcagttgcttccctgaggagggtccggctgcggccagggattgaaaaggatgcacacattgccagatcatcagctgcgtaaaaaatacaagagactgtgtctatctagtaaagaccccatctgcacagcagttgcaactgggactaccagcttgttaaatttgcagaagtctaccctcatctgttgtgctctgtctagcttctacaaaagcaagactggagaaataagcaggattgtacatcttttaaattgtgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggtaatatctcaataggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaattgtgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcatagg

SEQ ID NO: 881 - DNA, 2255 bp, Homo sapiens
attttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgggggcgaggcgactttggagctgcctcatgcagcgacctcgccttccgctgcgcctcctcccagaacccaagaagcctggaacctgtggcgtccagccctgaaaggaggaggcggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccgtgtggggccagatcaagaagttgacacagatggcggaagaaaatctgaagaaagcggatgaccagctacaatgagtaatctaatgtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaaagaatgctaatgactggtttgctgttaataaatacgtgggtaaatctctgtttggggctctcaactctgaaggctgtgagacccctgatttcccacttgacacctct

SEQ ID NO: 882 - DNA, 1862 bp, Homo sapiens
gatcctcccggcccaggccgagctgcccacgctgctgcccggggctcggtgcccggcgcggcctctgccggctccggcgggcgcgggactgcgagggtgctgtgggcccagaagcgcccatgcctgagagcgtccaggaccaggcagagctgggccttaagggcccttggaccagtgtctgtctgcagggagcccccggtagccactcggatcagcccgagggaagattctggacgagaccggggccgtcccccgggtggcccatggacagcagcaggggctcccaggagtggccaggccctgcccgcccaccatgctgcagtgtagacccgcacaggagttcagcttcgggccccgggccttgaaggacgctctggtctccactgacgcagccctgcagcagctgtatgtgtccgccttctcccctgccgagcggctcttcctggccgaggcctacaacccgcagaggacgctcttctgcaccctgctcatccgcacgggcttcgactggctcctgagccgacccgaggctcccgaggacttccagaccttccacgcctccctgcagcaccggaagccccgcctggctcggaagcacatctacctacagccgatagacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccagagactctacacctggactcaggcggtggtggggacgtggcccagccaggaggcgggggagccgtcagtgtgggaggacaccccgcctgccagcgccgactcgggcatgtgctgtgagagtgactcggagcccggcaccagtgtgtcggagcccctcacccctgatgccgggagtcacaccttcgcctcagggccagaggaagggctgagctacctggcagcctcagaggctccgctgccacctgggggccctgcggaggccatcaaggagcatgaacggtggctggccatgtgcatccaggccctgcagcgggaagtggcagaggaggacctggtgcaggtggacagagccgtggacgccctcgaccgctgggagatgttcacgggccagctcccggccaccaggcaggacccacccagcagcagggacagcgtggggctgcgcaaggtgctgggggacaagttctcctccctgaggaggaagctgagtgcccgaaaactcgccagagcagagtcggccccccgtccctgggatggggaagagagttagtacagcaggggctgccctacgtctccttccctaaggatgctggccagcactgtccagtagctgaggccactactgacctgccagggataaagaggaagggtctgcctgggtggtggctcaggcctgtcatcccatcactttgagaggccaggagtttgagaccagactgggcaacatggtgagactctgcctctacaaaagaaaaattaaaaaattagctgg

SEQ ID NO: 883 - DNA, 2078 bp, Homo sapiens
atgggttgggcattaggaacggcctggccccacaaatcacacaactggggtgtagaacaaaatggttccacagatgacaccaggctggtccagggccgatgcaggccagaaccccgctgggaggactccccagaacaggcactgagctgaggaaaggcaggacacgtggtctgctaccgaccccaccagatcttgctgggactctgggcagctccggagtaagagcagcatgctctgcaacgaagagctaggtccaaggaccgcaggcggaggcaggaagtgtcaagatcccaggttacggaatggcaccaagtcggtaaccaaaggaagcaacaacccgggttttcaaggcagtcgtgcaaggcggcgcgggggcgaggccgaggccactccctcccacttccttgacgctatttcctgggaggagccggagctcgcggcccggagccaagagattcccagcccagtgctccaaaatactcggcctgggggaggctggtccgtgagcgtgcgcccggaccgttccgccatgcatagtggacccagcactacagcaagcctggcacgacctctaaggcggttcgcggcaacgtccgcacgtcggctcgttggtctaggggtatgattctcgcttcgggtgcgagaggtcccgggttcaaatcccggacgagccctcctttaccttttactgagacaagagtgtcttcaaggaatatgttacctgaccagcgctgcaggaggcttgactgtaagtcatcaatgtacagtaagctcttttgtggcaccgcggtagcagaaagcatctcaatccccagacccgcctggcatgtcaggaagagacgaggcacgcccagacttgggcaggtccctccctttctgcttcctgacttccttcctggtgtctcaactcggccaccacagcctggtttcgctttgattgacacgcgtcaatctatagttgtggatgacagtgttcgggagagcccaggaactgtcaaaacttggttctctgcagtcctgaaggcactctgtctctttcggtcactccatctgacgattggtgcctgaaatacacctacggtttctggtcagcgtttatcagtggttggaagaacagaacccctaggaaccctgctgtcagcacgcagagtgtaaagtctcagatcaaggattcggagaaaggtctctacaggtccctcctcgttagtatagtggttggttgggatgagtcgggttggacccgtgcggatccaggaaaacagcgatcgaggtaaaagtaatggctgccgtcgtctgcccagcgcgcaattgtgagtgaccttcaccgctagcgcgcgccacccaccccacatgaacctgtagggttatgcccagtctacagacgaggaaaccaagatccagggaagctgagtcaccggcagagctgggattacgtctaagatttgtccagggggcgagaactgcagcgacaccatgatgatttatcatctccagaaaacaaaaaaaaaggcctagacacataaaaatggcttctctgtagagtgagctcaacgagctcaatgtgattccagttaaggaattgggccttaagccaaatgcgcctaaacgcaacttgcctctctattatttatccagaggatgaatttaattcctacgtacatgcgcccacatctcgtcagctggtgcctcagagaaatgcgctgacaaatcttaaaggtggggcttcatgacaaaagtccgcccgttattgctgctcaacagacccatcaagtcacgctgttggacaggcctcgtggcgcaacggtagcgcgtctgactccagatcagaaggttgcgtgttcaaatcacgtcggggtcaaacaaaacattgttttccctaatcaaatagacctacggtgacatttttcaggataggaaaaaaaaaaagcctcctcagtagaaggataggaggggaatgagacaaatatgaacgttattcagaagttgggtgcagactttcaacattatgtgatatatccctgtggcaaaactgcgcatgtatccctaaggtctataaaagtaaaaataaatttaaaaat

SEQ ID NO: 884 - DNA, 2197 bp, Homo sapiens
aaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagccttggattgtctcagtttataccttacccatgaacgaactcacactggagagaaacgatatgaatgtaaacaatgtggtaaagccttcagttggcacagttctgttcgaatccatgaaagaactcacactggggagaagccatatgaatgtaaggagtgtgggaaatcattcaatttttccagttcctttcgcagacatgaaaggacacacacaggagagaagccgtacaaatgtaaggaatgtgggaaagccttcaattgtcccagttcttttcacaggcatgaaaggactcacacaggagaaaaaccctatgaatgtaaactatatgggaaagcattatctcgccttataagctttcgaagacacatgagaatgcacactggagagaggcctcataaatgtaagatatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactggtgagaaaccctatgaatgtaagcaatgtgggaaagcatttcattgtgtcagctcctttcatagacatgaaaggactcacgctggagaaaaaccttatgaatgtaagcattgtgggaaagccttcacttgttccatatatattagaatacatgaaagaattcacactggatagaaaccttaccaatgtaaggaatgtgggaaagccttcattcgttccagttactgtcgaaaacatgaaagaactcacactattaatatatgagagaaatgctattttttaatttttattttaatagagacagggtctcactatcttgtccaggttggtcttgaactcctggcctcaggcatccctcccagcttgaagtgtcaataaaggaaggcaataaaatgtagagatggagttaggtgatgccacgctgggattcactggtggcctatcttacatatgatttcgaaggcagacatgaggaaggccttagtcacattttagagccagccaaattcacatgggctgtgtggccccctgattctagcccattttcctgattctctggcttgtcaatcaagagtatcctccaaatctcttgactttccttttttcagaggtgtaggtttccaaagatgtccccagaagctccacattcaagttctatctacagtttggtttttctttaagtattgtaatgtacataccagagagataatgcagactgtcatgggtggggaatgttctctgatgctcaactcccctagtctgcagattgagttggtaggaggtgtgatttgtttacatgcacctttgttcctgctggtagtgaccttgttcttgattcagcctgacagctactatgctgccatcagaaccaacttgatgagagctctgctgccctgtgcagtgactggtctcatccaggactctcatgtgagaaggaacaccttgctctggtcaggaaatgtccagtgtttcctgttatccacaggagaatgtaatgcctcagttcattttcagttatctttgattatatgtgattgacaatgtgtatttttgagggagcaaagatttctgtacatatttcttaaaaatagtttattcagctgggtgcagtggctcatgcctgtagccccggcgctttgggaggccgaggtgggcggatcacgaggtcaggagtttgagactggcctggccaacacggtgaaaccccatctctactaaaagtaccaaagttggccgggtgtggtggtggatacctgtggtcccggctgctcgggaggctgaggcaggagaatctcctgagcctgggaggtggaggttgcggtgagccgggatcgcgccactgtactccagcctggacaagagagcaatactctgtctc

SEQ ID NO: 885 - DNA, 2145 bp, Homo sapiens
caggaagaggcttgtgccgttattctgctggaacatggtgccaatccaaaccttaaggatatctacggcaacactgctctccattatgctgtgtatagtgagagcacctcactggcagaaaaactgcttttccatggtgaaaatattgaagcactggacaagaggttgcccctttagagaaggcgtgtattctccagtttgctgctgtgcccaccttagtacttcctttactcaggcaaccttcctttgtgctttgacccatttggagcaggagtgcctgacattgacatctgggatcctgacaccattgatagaagtgaatcaagcaagtttgtgccacccagaagaaacctccacctgcattgggaagctctggcgactgtacccctaaaactcttaattcctcaaatgttaatgtttgccacaaatagtattgtcaaatggggattaggtacaattcaagagatttcttgattattggacataacatacagttttataatacttctcaaatgcagatggtcatggagtccttctcttggggtataatacttctggtaaagcaaatattctttggaatatagtttaagaaacactgctttagtgagaataatttagatcattaatttatgtaaaaaacttaaaatgtttgctactatgtcttagggttttgggggtatagagacaaaagatacagaccttgcctcaagaagctcttggtttcagtgggacacagtgaaatgattacaatgtaccatgctaagtgctgtgatcaaagcaaggattcttgggactggtaaatgtctaaagtgagttttggcaatgaccacagttaatccggggagacagaggaggattgtttgcaaggcaaagagcagcacatcagaaagcacagagtgagaaggaagggactgcttttcttttacttcctttctatattgtatgttgaagttcaaagcaccttagagaagattttcagttcagttgagaaatatgtaattttctgaattactaattttttctgctgttttataggacagtaataccccacttttattcgctataatttgcaagaaagagaaaatggtggaatttttattgaaaaacaaagcaagtacacatgccgttgataggctgagatggtacagtagttcttttttttttttaaataaaaactgtgtattctagagtggtaacagtcactgaagtcagaaatattaataagaagattaacgtaattattggcatatagtgaaaaatatcaccatgaataatcagatagatcagcaaatatttggactgagtaacataaagaacagtatatagtaggattcatcttctcctaaatatagagtgtttgttatttataattggatgtttttggtactgtaatcttgtattagctaaagggttttgtattagctttattaagtttttttggagatgcaatctggctctgttgccaggctggagtacagtggtgtgatcttggctcactgcaacctccacctctcaggctcaagtgattctcctgcctcagccttccaagtagctggggctacaggtgcacgccgccatgcccagctaatttttgtatttttagtagagatgggatttcaccatgttggccaggatggtctcgatctcttgacctcgtgatctgctctccttggctcctcaaagtgctgggattacaggcatgagccactgcacctggccagttttattaatttttaaagtgtggacttttagtttatgactactggcattgtcattattattattgttgttgttgttgttgttgttgttttcagcctgcagataactcttatctgacccctagctgatttgaattatatatcagactaggaaagcaatggggaaatcttcatctaaatctttacctactttagataagtgacctcagcacagtttcttggccatcaaaggactatgagttagcaacttgtattatgtcataccccagtgggacaagaggcttccttgttgtccttttctttcagccttggtgataatttacaaagatgaacacttgagcaccctagatgcttatagacccaagctagtacatgcaaaatgttattatgtctacactgacaggtggatattaaattggtaaagtgt

SEQ ID NO: 886 - DNA, 2073 bp, Homo sapiens
agtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccaggtaaaaaaaaaaaattccgtaactctctggttatgagagtctggggagccaactcatggctttggggcaaaatgctcactcctcgggtccactgggtgccgctccgcttgctctcgactgaagtccccgcatcaccaccgcacatgtgcgtgagcgctgagctgcatgggaacacaggcgctgttcctcccttcaaacacgcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctagatgtcacagaggtccactcagtgacaaacacacactgaaggcctgaggaagacgagatgtcacagaggtccactcagtgacacacactgaaggcctgagggagactagatgtcacagaggtccactcagtgacacacactgaaggcctgaggaagacgagatgtcacagaggtccactcagtgacaaacacacattgaaggcctgaggaagactagatgtcacagaggtccactcagtgacaaacacacattgaaggcctgaggaagactagatgtcacagaggtccactcagtgacaaacacacattgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacatt

SEQ ID NO: 887 - DNA, 2069 bp, Homo sapiens
ctgtcaatcaggcgcacggctggcagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatttcctatcgaagacatgagagaatgcacactggggagaaaccgtatgaatgtaagcagtgttctaaagccttgcctgattccagttcctatataagacatgaaagaactcacactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgtgagtgtaaaatatgtagggaagccttcagtcattttggtaacttaaaagtacatgaggctgggcacagtggctcacgcctgtaatcccagcacttagggtgggcaaattgcttgacctcaggaatttgaggcctgcctgggcaaaatggtgaaaccatgtctctacaaagaatagaaaaggtagcaggtgtggtggtatgcccctgtagtcccagctacttgggaggctgaggtgggaggatctcttgagcccaaggggtgggggttgcagtgagccaagatgcactgcaccccagcctgggcgacagagccagaccctgtctcaaaaaaaaaaaaaaaaagtacatgaaaggattcactctggagagaagtcatatgaatgtaagaaatgtagaaaagcattgagttctctcaggtccttgcataaacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacagaattacccggatgtgatggcacatgcctgtggtcccagctactcaggaggctgaggcaggataatcacttgaatccgggaggcggaggttgcggtgagccgagatcgcgccactgcactccagcctgggcagcaagagcaaaacaacctctgtcacacaccc

SEQ ID NO: 888 - DNA, 2321 bp, Homo sapiens
atcattctttgggttgcggttgtcaaggattcagagccgatgtgatctgcgctaggtggcatctcctctcacggatgcctcgatctcggggtttccagaagaaaagatcaagggagaattatcaagaatagattatttttctgaatagttaaacctttgatggccataaccttgacccttcagactgcagagatgcaggaaggacttctggcagtgaaggtaaaggaggaagaggaggaacattcctgtgggccagaatcaggcctgtcaagaaataaccctcataccagagagatctttcgtagacgcttcaggcagttctgctatcaggagtcccctgggccccgggaggctcttcaaagactccaggagctctgccatcagtggctgagaccagagatgcacaccaaggagcagatcctagagctgctggtgctggagcagttcctgactatcctgcctgaggagctccaggcctgggtcagacagcaccgtcctgtgagtggagaggaggcagtgactgtgctggaggatttggagagagagctggatgacccaggagagcagatggcaaggctgggacttggaatgtggagttagccccaaagagggagatttctcaggaagtgaaatctcttatacaagttcttggaaaacagaatggtaatattactcagattcctgagtatggagatacctgtgaccgtgagggcagattggaaaagcaaagggtgagctcttcagtggagagaccctatatctgtagtgaatgtggaaaaagcttcacccagaattccatccttatcgagcaccagagaacacacacaggtgagaagccttatgaatgtgatgagtgtgggcgggccttcagccagaggtcaggcctattccagcaccagagactccacactggggagaagcgctaccagtgcagtgtttgtggcaaagccttcagccagaatgccgggcttttccatcacctcagaattcacactggggagaagccttaccagtgcaatcagtgcaataagagttttagtcgacgttcagtcctcattaagcatcagagaattcacactggagagagaccttatgaatgtgaagaatgtggcaagaacttcatttaccattgcaacctaatccagcatcggaaagtccacccagtggctgaatcaagctagctccttggaacagacacttacacttggagccctgagacccactgtaggcatctgcaaacaacagcaacaacaaagtgggatggaaagaaaaaagaacaaaatataagaacataaaaaagaatcagacagaagatactgtgttttctgcaaattgaaagtttgtggcaaccctgcatcaagcaagtttgtcaacaccatttttccaacatcatgtgcacacttcgtgtttctgtgtcacattttggcctccctattccctgagacacacagtgttgaaatgaaaccagttaataacactacagtggcctctcagtgttcacgtgaaaggaagagtctcacatctctctctttaaattaaaagctagaaatgattaagcttagtgaggaagacatgttgaaagctgagataggttgaaagctaggcctcttgtaccaaacagccagttgtgaatgcaaaggaaaagttcttgaaggaagtaaaaccactccactgaacacatgagtgataagaaaccaaaacagctttattgctgatacggagaaagtttgagtgatctggaaagaagatcaaaccagccacaacatgcctttaagccacagcctaatccacagcagggtcctaactttcttcaattctgtgacggctgagagagatgaggaagctgcagaagaaaagttagaagctagcagaggttgcttcatgaggtttaaggaaagaagctgtctccacaacataacagtgcaaagtgaagcagcaaatgttagtgtagacactgcagcaagttattcagaaaacctagctaagatagtggatgaaggtggctatactaaacaacatatttttaatgtagatgaaacactttatattggaagaagataccatcttggacttccataactagagagaagtcagtgcctggcttcaaaggacagtctgcctttcttgataggagctaatggagctggtgacttgaagttgaagccaatgctcatttactaagctgaaaatcctagagtccttaaggatcatgctggctgggcatgctgtaatcctagcacattgagaggccaagtcaggaggattgctgagcccaggagtttgagactagcctgggcaacatggaaaaaccctgtctctac

SEQ ID NO: 889 - DNA, 2147 bp, Homo sapiens
ccctgcggccgcatctcctgtccgcttttgtctgctctctgcctccattcccgtccttttcgctctcatctttgggcgctttgtgcagctgccttctttgtctccgcctctccggcgactgggctctcccttccctccctctcctccctcccccagtgtcaagaagccatcggcctcaagggcatcgatatttcagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtggtgagcccgggggcacggcccaggtgacatggggtgaagccacctgcgggtgcgtggatcttaggaagaggaggatgagagcttctccccagccttcctccggaggctgaggaaatagagcctgctttgggaccaaagtgcagggcgtgcagtgcggatccaggggctatgtcagtgagggtggggtggaggactcctaaagcagaggaaccagagggacaggtgagcgtttgaaagttcgaggatccaccggaggaatttctgggggtaaaagcaaaggaggtggggagcaggagagagagggtgggctgggggtgggggccttgagctgctgttatccaccctctgtttttccaaagaactggtccccgcacaggcttcagagtccttccttccctctccatcacctcacccggggcgtgaactccccctttcctggcttctcccttctgccccctcgtgggtggaagaactcaggagtgtgtgggatgcccagcctcgttcccgagcgcagccgcccaatccgcgtttcttttcttccttctgccctttctaaagccctaaaaactggtcctgcattgccctccacaccccaatcccctccccctgctcaagcttctggtgccagagatcagtgccctctccccacttctctctagcccctcatcctcatcctctctggatctctacgacgcttaacaccgcagtgcccatttttctgtccctgttttccttcccatcaccagcccagtgtgcaatccagagagagagagagtgatactgtaaaatgaaatgtatttagaatgctcccccatttgggtccttgttcatctggtgatgcactttctgagcctgcctctctcactggggtttcctcctgctttgcacaactttgctatttcgcaggctctcccgtgccccagctcacccgagccgggcggggtggtggtgtgtgtgtggtgtggttctagctgaagagtttggtacagtggagggcgggtccctcagcctggcataggggctgtctcctggttccaaccaggccgccttctagtgcaactggaattcccacctcctggtatttctggacaccactccctttctctggatcatttatgcttttagaactttgagagtcttctatttaattgcaagtagtaacagctgcatctgcacagcgctgtctccaatactggttccccacatcaaaggcagagggagaaaacagaaggctgggaaagatcaaagtgacttctaagtcattcaaagtagctaggagcctcccagcgaatagaacccgggtgtcccaagcctagagcatgacctagaacttcgctctgtgggatgatgttagcttgaacttcttgttgggcaatgcataggtgctaggagaatgttgacagtgagtttggggttcgctgggatgggatccgagatgtgggcagaggtggacaccagcaggtggaagaatgtggacaaggtggggggtaggggcagccgccgcttcgccactttccgcagctctggttttgctactgtgctgctctccttgggtgcatcctgtgcctggccacgctgccaccctccttgtcacggtgaccacgattgtatgacaataaaatggaccttttggcc

SEQ ID NO: 890 - DNA, 2587 bp, Homo sapiens
aaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgtaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaataagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataagg

SEQ ID NO: 891 - DNA, 2179 bp, Homo sapiens
cagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactctcagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaaggcaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggaaggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatcc

SEQ ID NO: 892 - DNA, 2390 bp, Homo sapiens
attgcaaattatggcttgctctaggatagaagcataggtgttgcatctgaaactcattctggctaaacacaatcccttctgattcttaggtccagtcaaaaggatcagttctatcaggagattacaacatgcctctgagaaatgattacttagtttagaagacagcattgcaattaaaaattcatgactgtagaattaaaaaaaaaaaaagaacccactctttccttccaggcttatgtcagacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcgtgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccaggtaagtcaggagctggctccactgcagcctcctccagtcttaccactatttccttaacagatggttgaatgcaagtgacataaagtgctatagtgtgggcagcttgcctttgaattccaagacatattgttggctggatgctttgggggaaggggagtgtgccaaaatgtcttggaggtatttctattaatttctcagaaaaggtgtgtttttctaagtgtcaccccacctgcttctacacaccttgaaaagtagaagtcatctgtttttggatgctttggccaatagcagaatattctgcaaaagttggaataactttcaatacttgaggattttacctactataatcttggtctgtatgtggctaagaattttgtgggggcatagtccccaaactaactttggaagcaagttgtcaatgaaaaagaaattaaaaagtaacttactatttcttgcctggtttaatgtgccttctttcctttctcccttccttcactttctgttcttccggtatgctcagtggcatttttccctctcttttggcagtttcagggacgaagtccctcccacctgatttttgttttgttttgttttgtttttcctatattgaatttttagttccggacgcattttgctttcttcctcttaatgttcaaagtatatttctcacccttccacggcctcgctcttcattctggattttgctctccttctttgcctctccagctttctcattacagtccctcccagctcgattgtccttaccttccccggttcttggaaaaatttccttccattttctgttcagtatcagccttcgcatccttctactactcaccccgccttcaccctccaccccacctccctccctcccctcccttcctctctcgcgacggtcaagttcgggctctggggaccagttgcgcgcccaagtttctgatgctcagttctgaagtgctcccagccctccacccgcctctccaaatcccatcaatggcctcctccccccatccgtcgagcttcctcctgctgcgtagtccagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtggggctggcttgtgctaggggctgaggctgggggctgtttctgggccctgccaccctgtttcccccagccctggtctgacagggaaggcgagggggcgctggtgcccctgcaggtgggcagggaaaccgccctcttcaggacgcgcttgtatttctgcatcctgtgtcctgagcctggcgcgggaaccgccactcaaaccctcagtgcagccgagatggagggaaaacaaaagtgaatttgagattcccactttacctccaatcacttaatcacaatttgttctggcacaaatgtctttcacttgttacatggtcataaataataaacagtgcgggacatctgc

SEQ ID NO: 893 - DNA, 1998 bp, Homo sapiens
tatcaaaatgctttctgggccagacatggtggctcatgcctgtaatcccagcactttgggaggccaaggtgggtggatcacctgaggtcaggcgtttgagaccagcctggccaacatggtgaaaccctttctctactgaaaatataaaaattagccaggcgtggtggcgcatacttgtaatcccagctactcaggaggctgaggcagtagacgcttgaacccaggaggcagaggttgcagtgagccaagatcacaccattgcacttcaacctggtcaacagagcgagactccgtgtcaaaaaaaaaaaaaaaaagttttctgccctcaagtcttctggggaggcagatgtttaaaccaacaattgcaggcagtaagattagtgctgatagaatcatgcacatgcaggatgccataggagcatggggaagagcacccaaatatgggagaaaggggcagagggacattgtaaacattaaccctgcagtagaagacagagcaaagcatgatttctcttttctctggcctgatttaattctaaggtcagacgttcagcttgatcataacctgtttataattatgactcagaccatttttccactcttggatcattggccattaatgatgaggggtctcaaacaacatgtctcagtgacacagtaaagcagaaattggctgaaagcaaagctgtttttatttctagcttcagtcagcacataatgcttaaaacctaaagaggaaagtaaaagcgtgttacaatctctcaaactttatcaagacagggcttagaacctgacatcctccgctatggtcattccattttgaaatgtagaaaatccaacttgtggatggtttgtctgtaaatgagctgaatgtgtgtgcgtgttcattatcaagcacgatatgctcacaaatgcacagtactttaagccttgtgcaagaaagatgctttcagtaaacatatttaaaaggttttattttccttactaatggtacatgcccctgcaagttcatggagaagagaaaaacaagtgtgggtgagctgatggaggcttcatcttaggtgaggaggcaggagagacaccctcccttcacttgtgccatccccacgctttgtccttaagctgtagtggtcccaggagataacctgtttacagcagcccattcagtattgaaaaatgaactccctcctgcagaatgttagaagaaacaacctcaaagacctcaggccgcctgtggtcattagtatgtggcagcaagattgaacctgcctgcctcctacctgtgtgagcctgtggtgtgggtgtggtaccaaggccctggctctgggcagtctgttggctcctggtgttcactaaggcgtggggtgacaggccatctggcctcgctctgccagtctgcagttctccccagcactgcattcatttttagtggtttctgatagtcacactgaattcctggacactttcttctcttcattcttagttatctttctcctttttctcctggaactgatagtttacactaaaacttttggctgtgaggacttgattatacacatttctaaaacccatgaaccttaatatctgacactgttactctcatatgcacacacaactaaaacataccaacctacttcatttcctagctgctaagatacaaggggagggacaataaaaggttaactgcagaatagccacctatgtgtcaggaaatggagggaggggaggcaatgtgtgagtccttttggagctgggactcaaccactaaggagactgaggcgggaggattacttgagcccaggagttcgagatcagcctgagcaacataacaagaccctgtctcaaataatacttagctattacccatattgcttttagcctgctgccaggaggggagaaatgttattgtttgaacagatgtcagatgtgagtaatgctcagctgtgttcaatgtagaaaattaataaaagttccaggagtcatcctggctagatcaag

SEQ ID NO: 894 - DNA, 2632 bp, Homo sapiens
tattatagagtcagtgctgtgaaatccctaatttgggctaacttaggctgagtttactgaagttaaacctcttaagtatgttctgaatacatagccacatgccggagttagtccccatgtgccttaaaggtagttgagaaaacaaaagagccctttaccccttagggcacagaaggggctgcgcttgggctcccagtatccccagctaccagacaattcttgaggtcggggtgcatgctcccctggggttcctgggtttgcacctctatttcctttcctctctccctggagcccacatcccacactgcctctcctcgcttcatgcacatggcgtgtgtttcagtgccatctacatgcagagccacctctctgagactgcttgtttccaaacacaaagtctttggcatctcctaaaatttccttcatgcagcttcccaccgcagccccacctctccgtcagtggaagttcacacctcaccacccccatcccatccatcaccaagctctggcaattttacttcccagctgtcccctgaatccttccgtttccctgccaaatcatttgatgttgattcaggcccctctcagtgctgcagagccctcctaagagaacttctcccacttctcttagccccagacccagcttcccttggttggaggagaaggaagcgcaaacgcggatactgcctgcatggtcctgcgaggaagccccaccctggccctggggccttctgtttgcctgtcactcgctctcgatgctaccttctctcaccagtgctttgggtccttcccagcacagggcccagcatagcccttctcttccacctagcagattccagcacattctttacttttcttttttttttcttgagacggagtctcagttgttgcccaggctagagtgccgtggcatgatgtcagctcactgcaacctcctcctcctgggttcaagagattgttttgcctcagcctcccgagtagctgcgattacaggcacacgccaccacgcccggctaatttttgtatttttagtagagatggggtttcaccatgttagccaggctggtctcgaactcctgacattgtgatccgcctgcctggcttcccagagcactgggattacaggcgtgagcctccgcgtctggcctccagcacattctttagctcttgacttggatgactcttgacctgggaggctgcctcgacacgtggagattggtgtgtcctgttagtttttatgcctcttttcctcatgaaacattagtcatgatgttatttctgtgattatcttttttttttgagacggagtttcgctcttgttacccaggctggagtgtagtggcacgatctctgcttactgcagcctctgcctcccgggttcacgccattctcctgcctcagcctcccgagtagctgggactataggcgcccgccacctcgcacagctgatttattgtctttttagtagagacattttcaccatgttagccaggatggtctcgatctcctgacctcgtgatccacctgcctcagcttcccaaagtgctgggattacaggagtgagccaccatgcccggccctgtttctgtgattatcttacattgtcattgtccccccaggcctgtctttcactgtggcatgcattgtctagggtagatgcttgttagatattttatgacttgctgtctttttcaacaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagttgagagccagctctgcggggtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgc

SEQ ID NO: 895 - DNA, 3409 bp, Homo sapiens
ttaccatctgctctcttctgcaaggctggattcagggccaaagggctctagagccacccatgttgacactgtgggccctgtggacacagtacctgaatagcagttaccctcttcagaaacaaagcaggcaccagcagagaggacgggctgtggtgcaggttccggacccagaactatgtagaaataagttcaccttcgtttacctgtatagtgggactgatggttctcataggatgttggtgtctcatgggggtacgcacacagaaggatgcctggcatttagtaagagcctgttcagaggtgctgctggtagcagcagcagcttggtcatccctaggaggcctctgcatttgggagtgggcagggcttagtgataccgggggtctttttacccatatgtcaaaagctttcctgcaaacctttgtgcctggggtgctcctccctttgcaggcagttgagggtctggcatgcttgggtgccgcgtccctggagggtaaaggtggtggttcactgcctaacgcactgcagggactcctgcttattgcagcagttgcattcctaagaaactttcacgttgccagaaactgcgagattggtttgttagagaacagtttaggggttggagcttctctgactcaaaaacaaattattttcctggagaaaagccagtgtgttttgttttgttgtttgagacagagtctcactctgtcacccaggctggagtgcagtggcacaatctcagctcactgcagcctccaccttccaggttcaagtgatcttcccacctcagcctcccaagtaggtgggactacaggcatgtgccaccacacctggctaatttttgtaattttaataggcacagggtttcaccacgttcaccaggctagtctcgaactcctgacctcaggtgatctgcctggcccaagtttttaatacctaaaacttttaatgtcgttgcaagtaaaagtcacgaatgataacaaaactgatcttagcaagcgtaagtgccaccttctctgccatcaggtgacatccatcaggctcaactttttctctgacctcttgtattgatttgacagctttacttgcagctgaagtctacgtgcccactacccagagctgtagccaggaccatgtaaaagagtgtggtctctctttaatcaactacattaggtcaaaacttcattggggaaacttggagaatttcccttgccactctagagttcttgcttgcaagcaattgcaaatgacctcagccaccttgagcagaaatgtgctatttattgtagcctagaggatcaggctcagaggtgtacccttggatctggcctgtgcctgaggggtgctctggctctgcaggtgcttggcagccatgtcaaattcagtgcctgccctgtctatggtaggcactggcccagaagactgccacagaaacagtgactcacaggccctgttactgtgtcccaggctcagggataaatttggttacagacaccaagcgtctaggcctcgaggctgagcaaggctgtgaggagcagccaggcactggggccctgttacaatggagtggggaactgatactgtcttctctgaagagttgtagtaaatgctcatgaaacaaggttcagagaggtagcctccagctcacacacaggactgacagtgccacatcatttctcctgtgtcctttctctgcctagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtc

SEQ ID NO: 896 - DNA, 3642 bp, Homo sapiens
aacctgagagaaagtacaacagaaggtacccttcatctctgctctgccaaagaatctgctgagcccccactaacccagagtgataaaagagagacttctcacaccacagcagcagcgactggtcggagttcccatgctgatgcaagagaatgtgctatttcaacccaggcagagcaagaagcaaaaacccttcaaacttcaacagactcagtctccaaagaaggcaacacaaattgcaagggagaaggcatgcaagttaatactctatttgaaacaagccaggttccagactggagtgatcctcctcaggtacaagttcaggaaacagtcagagagacaatctcttgcagccagatgccagctttctcagagcctgctggggaggagtccccattcactgggaccacaacaatttccttctcaaacttaggaggggtccacaaggaaaatgcatcattagctcaacactcggaggtcaaaccctgtacctgtggtccacagcaggaagaaaaacaagacagagatggcaacatacctgacaatttcagggaagacctaaaatatgagcagagcatctcagaagccaatgatgagactatgtccccaggtgtgttctcaaggcatctccccaagtatgctcgtgctgacttcagggagcctgtggctgtctctgttgcttcccctgaacccacagatactgccctcaccctggaaaatgtgtgtgatgagccaagggacagagaagcagtgtgtgcaatggagtgttttgaggctagtgaccaaggaacatgttttgataccatagattctcttgttgggacaccagttgataactattcgcctcaagaaatttgctctgtagatacggaactggcagaaggtcaaaacaaagtatctgatttatgttcttctaatgacaagacactggaagtcttttttcagacacaagtgtctgagacttcagtgtctacgtgcaaaagcagcaaggacggcaactcagtcatgtcccctctttttatcagtactttcaccttgaacatttcacacacagctagtgaaggtgccacaggagaaaatctagccaaggtggagaaatccacctacccactggcctccacagtacatgctggccaggagcagccaagccccagcaactcaggagggcttgatgaaacacagctcctttcttctgagaacaatcctttagtgcaatttaaagaagaaggtgacaagagccccagtcctagtgccgcagacaccacagccacaccagccagttatagttcaattgtgagttttccttgggagaagccaacaacattaactgctaataatgagtgctttcaagcgaccagagagactgttaccattgccaccgaagtccacccagccaaataccttgctgtgtcaattcctgaggacaagcatgcaggtggcactgaggagaggttccctcgtgcatcccatgaaaaggtttcccaatttccttcccaagtgcaggtggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggccccctcaccagcaagctctagggaaggagcagggcagcgctcaggttgggggacgagggtctccgtggtggctgaaactgctggggaagaagacagtcaggctctgagcaacgttccatctctctctgatacccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacactggagaagtctttcttcccggggtttcagccaaccgagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacggggcgccagagaaggaggtcaatcaaatgacggaaacatgggccacgaagcggaaatccagtcggccattttgcaagttccatgtctccagggaaccattctgagtgaaaatagaatcagcagaagccaagaaggcagtatgaagcaggaggcagaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcactcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctagctcctcagcgaagaccttggcatttatttcaggagaacgtgagttagagaaagcccctaagttactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagag

SEQ ID NO: 897 - DNA, 1768 bp, Homo sapiens
attttcgcaccacagcactgcacggaaagtcagcgtgacggggacgaggagccccgcggagggatccgcgcgcagttcagtcgctacggccgacggacggagcgccgcgcccggcccgagatgcctccgccggccttaaagggggcccataaagacgcactgccaagggctccgtgtgccccggggccgcgggaatgcggatcgcagccggcagggaggggccgcggcggagccttagacttgggggagccaaggaggccactcccaggaggctgcggagcaaatgactgcctccccgagcccctggctgcaaaagcagaggttgcccgtggcttttgcagctctggacacgcgggtgcagcccagggaacgtggacaagaggtgttgacggaccggaccgtgcatttgagttggggcatatcgaagtggtttaattaaaagccgcgagtgtggccccagatcctggcgttatcaaagcaaatcaaagcctttcttttccagccgagcgggccctgtggaaatgagatgtacatttacccttgacgcaccgcaagcctggccgaggctctcaggttaattgatatttaatggaaatcatgcccatgaatatagtttccatcatttcacccttgatagacgtcagccctgggcgcagggggaggctgaagaatgcaggagggggcattaggcttgctgagagagtaaatagaagagcggacagaaacgttctgaggcgggaaaaagggctcgcgctggggagggtgacatttcctcgggcaggacgcggctcccgggtctcagccccggcgcgcagcgaaccagggccggctgcggttcccggaggagtgcggagggcagacgaccgcaagttccccccaggagcctcccagccggcgttcagatcgcgccggttccaggcagctgcaggcggcccatcttatgctaacgatcctacttcctccgccaagcctgtgaaattactgccgagagagcgcgcaggcctcaaagttacgaatttttcccaaagcagagaaagagaaggctcagcctagtttgtgagcagagatgaagaaaagttgcccgagtcatgtggcccagtcgagtgtgaatcgacaaaatattcccgactgagccccgtttccttcgggataggtacaatgtcgtgagggcgccaggcccacagccttggaaacagacctccaaggcgcccctgctcaagctaaacgcaccacgccggctttccacaccaaatgcaaatttccgaaaaccccagacggcctcagagatgctgcaggctggcgagcgatttcagctacccctagctccttgtgggttggcccagcctgcgagcgcgatcctgacttgtgtccgggtggactgaaatatcatttttacaaatggagaaaatgagatcgagatggacagacatagcaaggtgataatgtccgactcaattatttctactgggaatgactgaaaggtaaaggaatcgttaatgaatctggagatgacagaggcatgctttatttaatttttaaattagtaaggagtgcagacttggggtggtggagagcaagggtttttttgttgttgttgctgtttgtttttgtggggttttttttctgctggttattgccaagtataatgactttctttaaatccgaaggcgaacgaattgattctgacaattatggatttgtccttcaatcttgcaaatgcccaattaaaagattattattgtcaataaagccttggagctacctttgt

SEQ ID NO: 898 - DNA, 2487 bp, Homo sapiens
gagttcctgaggggcgcctgcggggggcgtccgctccgagcgccgaggggccgagcggaggaggcgtcccagggacacgcaggggaggccggccggcctgcacggggcgctcccgcctcgggggccctgtctggcgcctcagcgcgcgccccgatggtcacctgcgcccacctgggccggcgcgcgcgactcccggcagctcagccctctgcctgcccaggaacctgcttttcccaagaggagagaatggctgctgggtacctgccccgctggtcccaggctggattgccgtggcacaatctccgctcactgcaacctctgcctcccggttcaagcgattctcctgcctcagcctcctgagtagctgggactacaggaattagtaacctttgaggacgtgtccatggacttctcccaggaggagtgggagttgctggtgcctgctcagaagaacctgtacagagaggtgatgctggagaactacaggaacgtggtctccctggaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaaccacggtatggccctgactatccacaacaaaatcaacacggcagagaaaccctttgagtgccaccagtgtgggaaggtgttcaaccggaggcattctttgagcgaacatcaaagaattcacacgggggagaaaccctacgagtgtcaggagtgtgggcgagcctttacgcacagctccaccctcacgcgccatctgagaactcatactggagagaagccctacgggtgcggtgagtgcgggaaagccttcaacaggatctcatcgctgactcagcatcagaggattcacaccggggaaaagccctataaatgtgaagactgtgggaaatccttctgccagagctcttacctgatcttgcacaagaggacacacaccggagagaagccctacgaatgcagtgaatgtggaaaggccttcagtgaccgttcctctctcaaccagcacgagcgaactcacacgggcgagaacccctatgaatgtaagcagtgtgggagagccttcagccagaggtcttcccttgtgaggcacgagagaactcacactggagagaaaccctacaggtgtcaggaatgtgggaaagccttcagccagagctcatcccttgtcacacatcagaaaactcacagcagccagaaaacctataaaatcattgactgcgggaaagcgttctaccagaacagacatcttattggatattagcaattgcacgctgctttgtaagccactttttagtactctgacacatacatgtggttatcttttgccctgttgtgatggataatttgaaaagaagtgggtttatgtcaccttctcaccttcttataagaaagctctgagaatgggcatttttgtattttgttgttgttgttgagatggagtctgccacccaggctggagtccagtggcgtgatcatacctcactgcagcttcaacttcctgggctcaagtaatcctcccaccccagcctcccaggtagctagtactataggtgtgcaccaccacgcccagcaaatttttaaatttattatagagtgggaggcagggtgcggtggctcatgcctataatcctaacactttaggaggccgaggcgggtggatcatgaggtcaggagatcgagaccatcctggctaacacagtgaaaccctgtctctactaaaaatacaaaaaagtagccgggcgtggtggtgggcgcctgtagtcccaactactcaggaggctgaggcaggagaatggtgtgaacccgggaggtggagcttgcagtgagccaagatcgcaccactgcactccagcctgggagacagagcgagactccgtctcg

SEQ ID NO: 899 - DNA, 2828 bp, Homo sapiens
tggctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatccatcccagtttctgacctgtagcatagtccctctctctgaagaacttcctgtaatatttcttgcgagatggagtcttgctctgtcaccaggctggagggcagtggcgccgtctcggctcactgcaggctctgcctcccgggttcgggcgattctcctccctcagcctcctgagtagctgggactgcaggcgtgtgccaccaggcccggctaatttttgtattttggtggagacggggtttcaccatgttggccaggatggtctcgatctcttgacctcgtgatccacccgcctcggcctcccaaagtgctgggattacaggcgtgagccaccatgcccaacccaagaatttacatttctaacaagttcccaggtaatgcttatgctgctggcctagaaaccacacttgaagaaaccactccttcagaaaatagttcttgtctcccaagaggagaaggaatgcgaaagaggattttaaagaaagcttccaaattgtggccaactctgatagaagatcatagacacttgaaactcagtgctgaagaggatgctgtagtcatgcccaggctcaatgggaaagagctccaggatgaggggggcttgcataccatgggacgggggaggaattgacaacaaagatccacatatttatcatccacaaggttggttggtcttaatcttgtgcttgtcgtatccattttataatacaatcacattcgtacacttgactttaatttacatcacagagttatatgtctttgatgcaagacttcagcaaaatggcccagccagggtgttagggttttctggcactctacccatggaagaggagaggattggaatgaagagaggaaggcacaagggagaaagctgacatatggaatcaagttggagaaaatagtgggaaatagaaaagtgtgtgcaaagatttattgtgaattcctaagtactcaattaaaagcagaccaaaacttgagaattgggttgaaggctaaggactgtgagtggggaaagggtggacaatgcattttcagggaccagccccatcactggctcagggtttcctaggcacggctcttctcaggcaagctgtgctggaagcctggattacatctggaattcaagaactctccctgtttcaaatacagcctagagaacacaggtggtccacaggctgcatttttgccacccacaactttgggccacatttagaggagccagtgaaagaatcaatctgctgagtcagaagaaaattcaacaagctcttatccaaataggcactcgtacgtgttgccatattaaagatgcaagtggtcccattagtaataaactcttcagacacaaaaggcatttgtgtcacaaattctgtacaagttataaatagagggaaaagcatctgggaatgtgaagtcaagagtcctgtgttttgactctagctcaagtgcagaccaaaaacataggcgttcacctctcagttcagtttaacaatatttctcaaggatctatctgtgaggcacttggatgcatggtctataaataagaccaagtccctttcttgaaagtgcttaaaatctaatgaaggggagggagataaatacacaaatcaatggattcaagacagggtattgaagatgttatgagagtaatacaagtaaaacattgaccaagttaaaaaggacaaaacaaaacagcaagtaaggtgttaactcctccatattccattagaatactcttagcatgcccagttcctgacacaaaagtaggcatttgataaatggctctttgagtaaattaaatgagcattatctcttcccagacctaaacagcccaccaatgacctagtttacaatttatgcactgttaatttgcctaattagacccagtatctacttctgtgccacaaaatcatatgattagagcattaacagtcatgaaacgccttatagacctggacttctccaatcgaggacattacaatctactaaataaagaataacttgaagagggatttaaatagaggagggtattgagaaagccataaatttagtaaaagagaagttaaaatcggcacgtggggttcatagcattaaaggaaatgatttacctctgaaactcatgtttgtttctaccagatgagcaggaagagattccaaagaggaaaagatgattagaagtaggaataactagcttgggcaaagtggcaagacctccatctcttt

SEQ ID NO: 900 - DNA, 1862 bp, Homo sapiens
aaaaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggagataaactggaggggaagacgaatggcaggagggtgaagaggaaactgaattactgtgcaaacacccgccactcaaatccgggtggttactgcagagtgaataacgataggtactatttcgtgtaaggcaaagtcctttgaaagggctcctagagcgtcaaggcctccacctgatgaatgaatgagtcaggcaggcccagctccacttcacggatgggaaaactgaggtacgaggcctcgctgaaagatgcgaggcagagcggagaaccagaagcaccacttctctcaggctgatgctctaatctcggctccccccgcccctacaatggcgtagacggcctccgccgcccgactcacacacaccctcccccgggaacggcaagtctcctcgggttccaaggacagggtcaaaagacagggtcaaaagacaagaggcccgaggcgctcccgccgtgatttgcagccagataccgttgggagcgcagccagagagcgttgggagcgtgcgtacccccagcccaacatggcggcggcagcggccgcccccgaccccaagccctccctcagggcccgaggcttctcctcagggccttccggtgggcgggaagacagcgcaaccccgccaggcctttctcgtcgctgcgcctgctcgctgaaggagtcacctacccgacgagactaacggctgcggcgcggaagccccacagcccgccgagaaccaggaatacgagagccaggcggcgcggcggcgggacctgtactgagcaagaaagaagatttcaaagtaatttattgttatgagatccgtgcttttatcttgtctcagactcccaatgataggcacatactctcctctgtacatttaatgaaactactaaaatatttcgatttaaatcttccacctatttgttttctgtgtatcctacctgttcccgaccttgacattttcaaagaatacaggttacttattttgttttttggtggtggtgagttttttgggggttttgttttttggtttttggttttatttttggagacagggctttgctgtatcgcccaggctggaatacagtggcgcgatgatagctcactgcagcctcgaactcctgggctcaagggaccctcctgcttcagcctcccgagtagctgggactacaggcctgcgccaccacgcccgggtaattttttattttttgtagagatggggtgttctatgttgcccagtgtggtctcaaactcttgggctcaagagatcctcccacttctgctgcccaaagtgctaggattacaggcatgagccactgcgccgggacagttattttgtagagtgttctttaatttggatgtacctcatcttttatgtatctttgggaggaataccacataactcatgtggtttatcccatcgagagacacacagtgtcaatgtgttccattcttggtgatgttaacttttattacttagtgaaaataattctaagagatttcaccactgtagagtgaataaatgaatatgtgggattcatcaatgaataagtaaaaggatgccaactggcaaaagaactgagttgggaggatggcttgagcctgggaggtcgaggctgcagtgagccgtgatggcaccactgccctccagcctgggtgacaaagcaagaccccgtctcagaaaaaattaaataaataaataaatacccagcacctg

SEQ ID NO: 901 - DNA, 1835 bp, Homo sapiens
ggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacgggattctgtgtggctgtgcataacccagaagaggagagaactgctgtgcgtctgaagtgatggcggagatgtgatcttgtttaatccacataacaaccctattagacagggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaccccatgaatgtaaggaatgtgggaaagcctttatctctgattcacatcttattcgacatcagagtgtccatactggggagaaaccctataagtgtaaggaatgtgggaagtcctttcgtcgtggctcagaacttacccgacatcagagagctcatactggtgaaaaaccctatgagtgtaaggaatgtggaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaaggcctttggtcgtggctcagaacttagtcgacaccagaaaattcatactggtgagaaaccatatgaatgtcagcagtgtggaaaggccttcattggggcctcacaccttagtcaacatcaaagaattcattcaggacagaggagtgaatgaagaaatgagggatggctcagaatttgattgacatgagaaagttcatactgatttggaaaaaaaaaacttatgattctaagtgtgagacaccttataaatgttaggaattagcagggatttatttatgtttcagaatttattacacatcatgatacaactggtgaaaaattgaagacctccatgaatgtgaagaaagtagggaggcctttttggtggctcagaaccaagtcaacctcagggaattcaaatgggggagaggagggcagtgaatatgctgagaggagttaatcattcagacctttatcagcagcagagtcattagcccttaggggaaatcagatgattcaaaatataaatgcgggccgggcccggtggctcccgcctgtaatcccagaactttgggaggctgaggtgggtggatcacgaggtcaggagatagagaccatcctggccaacatggtgaaaccccgtctgtattaaaatgcaaaaaattagctgggcatggtggcgcgcgtgtgtaatcccagctacttgggaggctgaggcaggggaatcgcttgaacctgggaggcagaggttgcagtgagctgggattgatccactgcattccagcctggcaacagagcaagactccatctc

SEQ ID NO: 902 - DNA, 2162 bp, Homo sapiens
ataagccaaatactgtgaatatgtccatttatctggggggatatattgtaatatcagtcaaattcttaaagagattcctgactctaaaaaagtaaagacaactgcgaaagtaatgagaagcttttacccatcttagtctgaaccagctgggacagatggtttaaagaaacctggccttcttactaccctagagagaaagatattcccattttgtggctgcactcattttctcagttggtacttctgtgctttattagagttttgttaggtttttgaatgaggtattaaacctcacagaggaatgccatggactcatatttcaatgaattttaatagaataatcactggcaattacttggcatataaaaattgctctgcaaatgttaagagtattcattggtgtgataggtgggagttccaatgccatgatgagaacgttgcctttcacagggcctgatgtcatcacaaggggcttgccacctctgtgctccctcctgcctgcatgcaacctcagattcttcagcaggaaggatgctgtgagctcatgaggtcagcttttgcccctggactgtgccagtgtttatatgaacctcaggctgttctccttccacttccactggggctgagctttcctcctgccaggaagttctcttatttatctgacctcagtcattcataccacaggacactctcatttccttctcctggaaggattttcttgagagaagggacaactgagcatttctccgctctcccctcctccctgggctcatctggtctcacgtggatgactccacacttgctgaaccttcctatgtcctgacctttaattatcttcagctccctctgaagcctgggactcccaccacccaggaaggcaagttttttattccttccgcccttttaaaggatgaatattgtggctggggtaattctcagcacttaatctctctggctattgtgtctgtgtcacctctctcttcaactgcctctctccagagctccttctgtgtaagcctgcccgcagccttatagtggggagggaagtctctcaccaggggaccctaatcctcttacaaaggggtttggggggtcttgggatggtgtgttccagtttctgcccattcagtggtgctggagggagacttcagccttggccaagactggcatggagccagcacttcttgagataaagccccctctgcaggctctctgtctgccctgggccttcccagggagacaatagttcagagttataaggagggctggccaatctctgcccaggcatggggcaaagatctgaggggccagatcttcagagctgcactggaggtgaggcttacctggattggccagagaagtagggagcagcagtggtggaagtttagcaaatagttccgcctcccatagctgaagcttgtaactgctccacagctccctggataacaacctctaaagctgtatggagcagtctgagctggagagattcctgtcaaccaggccacctctccttcagtgtcctttttcccagaacctgtccatggctcatagacacatggagaactaaacaaggggttgggatttcctaggaggagctgaagcagatcgctgcaggttggagagtggagtctctaaaaatctgctaagaggctgccaagtcaaggacaggtaggtattgggtatagggggtaattctctaggaaaactacagggggaagtttatcaccttcctcatctattcaagcactcagggcgaaggggggtggcccacagactgctgttgcttatagtcccaggaatgtcatgaggccaaagctctgctcctgctccttagggtgggagacatattccagagctggggcttctccagggccaccatgtagatcacgtacagctgcacaggttgtacactgcacagctctaggctacatcataaagggcccacaagtgtagaagtctttgcctattttgtccacaaatgtattccaagcttctagaataacacctggaacacagtaagtgctttataaaaaattggcaaatgggttgggtgcaatggctcacgcctgtaatcctggcactttgggaggctgaggcgggcagatcgcgaggtcaggagattgaaaccatcctggctaacacagtgaaaccccgtctctact

SEQ ID NO: 903 - DNA, 2488 bp, Homo sapiens
atcttggctcctcccctggtatatcttctttagtgagaggtctgttcagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggacgacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagatgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaact

SEQ ID NO: 904 - DNA, 2130 bp, Homo sapiens
agctcggcatgcctcggctccgcggtggaatctggcctggcccgtcatccagttcctgtccccggcaggctccggcccagaccaggcccccggcctctcaccccgacctcaggtttccgccacagcccccagcccaggccctggacacgcgtccggcccctgcctccgtgcccggcccccacgccgcctcccgtccctcagatctccggccggcgtccccacgaccggccccgactaggcccccggctgggcccttcttcagctgggcgcgcacctctccttggagtagagctgcagctgctgctcctgctgcttcttccggataaacgccatggagggtaggcgcgggcgggcgcagagcgcacaggcaggccccgccgccgcctgccgaggaggtccggaggagccggggagggcgggattggtggccggctggggagcgcgcggctgccggcctggcttcccctgcggcgccgctgggcggccgagagcccgacgcggcgtcccggccgcgctcaccgcagcatcctcgcgtggggactccggcggcaccgtgactcaggcccggaggaggggcgcgcggtgacacgaggcgccccaaactcaggccgcctcagaggatcgccagggccagcggccagactaggatccgacctcacacactaaacgtttcaccactttaccaaccattgcaggctgcgttttaaatattttacgcataaaaagggatgctggcccataaaccaccaatctgttggccacaaagacttgaaataacaacgttttgtgtcctccattgtgaaaaaaaaaaaaaaagacggaagttaaaggggtgaaggcaactcagtcgtaactattccaaatacaccaggaataagtggagatttatagccaaggagcaaggagcaggtgttcggaaaactgctaagaggaaacatcaattctgggggaaattctggctgaaccaacctaacaggagtcccagtgaaggcaggccagggggtcagatactaagggtaggagtaaagaattttgatcacatatggagggtgggggattcttgctaaactgccgtggcagtgttacttcctaacactgcatttacaaggaagtgcacacaaggacctgggagaagattcagaagcctaactgaagtttggccaagcaaagaatctttaacacagtctcttgattgttgagataattgctcgcatgatttttttttatataacagctttattgggatataactcacataccaaacaagtcaaccatttaaagtataccattcagcgatttttagtatatttccagatatgttcaacaatcaccacaatttgagaacattttcatcacatgtaaaagaaacccataccctctagctgtcactcttcctaactctaccctccaaaccccagccctagcaaacaataatcaatttcctgtctctatgggtttgcctattctggatatttcatataaatggagccatacaatatgtggccttttgtgtctggcttctttcatttagcgtaatgctttcaaggttcatctatgttgtagcatgtatctgtacagtacttcgttcctttagattgctggagcatattctgttgcattttgtttatccattcatcagttgatggacatttcagttgtttccacattttggctattgtgaataaggctgctgtacacagtcatgtacagtttttttatggacctatgtttccatttctgttgagtggaattggaatctaagagtggaattgctggatgtggaggcgaaagcagctccatcttggaagctaatcctccgtgttgacttctgattgaccccagttctgggaaggcctctaagatttctactttatctattgttccttgtgtaagagcaggtatctacccagtatgttctgtccttaattcaaacaacttgatgttattatacttcaattgtcctacacatcccttctgaaccacccctcccctatggtatataagccctaaggggctggagtgatggctcatgccggtaatcccaatgcttttggaagttgaagctggaggattccttgaagccaggagttcgagaccagcctgggcaacaaagcaagaccctgtctctac

SEQ ID NO: 905 - DNA, 2344 bp, Homo sapiens
ttcttgagattctaagtcccacaaacatttactggggcaggcggaccttgtagtcttgtgagactatggacagatgaggactgtccatggttagacatgattagtgaacaatcctatactgggaaaacacatgcttaaatgggacaatactgaagtattatttgctgcattctggacttcttcccttaatctgcatttttttctgggcaaaaagccagaatggcccaaggcaaaggttttaaatagttcccaggaagccacattcagactgcaaaggcatcctactgaaggggccatggtgttcagaaaggtagatgtcctctgggtcttgccctgaccccaagcacaaggtctttccccttctggagtccctgccgggtctctgctcagacgtggtctgccctgcagctgttgggctgggagctggagggcaggcaggcaatgggtggaaatcaggggaacatttctcttcaaaaactgctgtttgaaggcagaaaccagctgtgcacctttcctaaggattcaggatgaggatgttgggatttgagaagatagaaagatctaagtcaaaagccatttgaataaggtagaaatatctttctcctgaaaggaggctaaacatagagacataccccaaagacatgagaaaatgagagtctttatacttggtgaaaacaagaaatgaaagatgatggaaagatgcatgcaaattatcttccagcttgctcttttgaagatgctcgtctaaaaataagatcacgtggaggagaaatgacatgtctggtgctgaaaacaaccctactgggaccaggagatgtggagcaaaatgtattcagaaagagactttgctctggaaaccattgctcactgccctgctgccaaggtcacagagagctggagctttgctgctgcaaagctgtttacatacaaggacacacaggaacgaaaggtcatgggaggtacttgagcctggagtctccaaagtcaaaagacaataaacacaccaactttcagggcttttaacaagcacaatcgggccaaacaaattctcactttggatgtagatccacaacatcttgcagcagacggaaataggactggggcaagagttggtacaaacagaaatactaagtttatcacgaccaaaataggcaatggagggtaaaagcccgcaacctacttcaaatatatctgaactggtgttaaaactaagctagcattgaagagagggataaaattcaggagcaagtttccaaagagactcataagaacccagagagaggaaaatctttttcagaaaattcataaaagttaatgagtcgccattctgatgtaacggagagaacttcagtaatatgaccagtgatggagttggtgtgaaatgcatagactccactatgacctgaccgggtatttcctcagcaaatatttgggtatatttaattgaaatgcatttgtggcaaaagtcaactcctacaaaaaaattgttaaaatattcttcctggaagttgtctcccaaagtgactcacatcaagtagtctgaataaatatggtgagacttggcaccctctgaggcatcatttgctaggaagaaaatgcttttgaatatcctagaactcttggaaaacttacagaaccattggcctcatgcaagcccattgtccctgtccaacacacccccacatcccctttccctcaccatcaggcacgaaagtccttcctaagtcgcaaatgcaaatctaactgactggcttccttcttacagaccaaccacagctacttgtctttgaaattcaacttcaaggaagacagaaaagtctatttttaatcagagaaaaacctcaaattgagtgcgaattactgcctaggccctgttgaatgcacactagaatcacttttgagatgatcactaattttatggagtgatatacaccagaatgaacttctagcctgctttataatcaatcagttaatcaacaagtctgagtggagcgtgtatgctttgcgttatctgcagtgcggcctgaggttacgggagaaaaaaatggcactgtgtattgcttgaatgctcagggctgcgttcaactaattttaaccattgaatcaaaatgatcaggtagagggcaggaaatgtagaatggcttgaacaactacctcatgaaaacatgcagtatgcgtttgtaattcagcatcttaaaatgtctcttttggcagtatttctttacaaatgtggcaaagcatgatatctttgagtaaatttttaaacttcacaaaagtttctgaaaaaaatatgtacaatcaaagaaaaacacttggaaataaattctgtctatagtttatgcac

SEQ ID NO: 906 - DNA, 2341 bp, Homo sapiens
cttgagaagaactgtccataccatggtggtggtaaggctttcaccagttctcaggatgcccatagggatgggtgaagcctgcctggcctgtggtgctttccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccatccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagcatc

SEQ ID NO: 907 - DNA, 2134 bp, Homo sapiens
gacggatgcagttatgccaagtattgcagccaggagtgtttgcagcaggcccgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacctgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagtggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctgcgtggtggaggttcgccacgggccgtccagtgttgaaatgggccatgagctcttcaaattggcccagatctttttcaacgggtttgcagtacccgaagccctgagcacaatacagaaagctgaggaggttctgtcgctgcactgtggcccatgggacgatgaaatccaggagctccagaagatgaaatcctgtttgttggacttaccacccacccctgtagggcctgcattgtggggttccaggaggattttgacccacagaaaaggagcccatggaacacaagttaaagaggttttgctgccaggtatggtggctcacgcctgtaatcccagcactttgggaggctaaggtgggcggatcacctgatgtcaggagttcaagaccagcctggccaacatggtgaaaccccatctttactaaaaatacaaaaaaactagccaggcgtggtggtgggcacctgtaatcccagctgcttgggaggctgaggcaggagaatctcttgaacccaggaggcggaggttgcagtgagccgagatcgctccactgcactccagcccaggtgacagtgtgagactccatctcaaaaaaaaaaataagaggccgggtgcggtggctcaagtctgtaatcccagcactttgggaggccgaggcaggcagatcacgaggtcaggagatccagaccatcctggctaacacggtgaaaccccgtctctactaaaaatacaaaaaaattagtcgggcgtggtggcggacgcctgtgttcacagctactcgggaggttgaggcaggagaatggggtgaacccgggaggaagagcttgcagtgagccgagatcgcgccactgcactccagcctgggtgacagagccagactccatctc

SEQ ID NO: 908 - DNA, 1984 bp, Homo sapiens
ggagttccgggtgggcgtgggcttggcgggccctgcactcggagcagccggctggccccgccgcggccgagcaatgaggagtacaccctccgggccagcgactgtggagggtgtactgggtaccccagcagtgacagcccaccggcgctgcgttcgatttctcgctgggccttagctgccttccctcagggcagggctcgggacctgcagcccgccatgcctgagcctcccaccccctccgttggctcctgtgctgcccgagcctcccggatgagcgccgccccctgctccagggcgcccagtcccatcgaccacccaagggctgaggagtgcgggcgcgcggcgcgggactggcaggcagctccacctgcagccccggtgagggatccactgggtgaagccagctgggctcctgagtctggtgaggacatggagaacctttatgtccagctcaagttgcagtccgtaggcacttgctttaaccgtgaagaattaccttcagtacttcagtggcctcagggtgaggaattgggagccaccagtgtgacaaataaacctggactctcagcaatgaggaaagaaacagaccaacaagttggggaaagaaagctcacatactgcggtgaccaggtaactctgttcacagaccaagccctcagtcaaatactatcttctgaggagggaagaatcaaggttatgtagacccatacagaattgccactgctaacacactttcatactgcatgacttggatacactccctattgctaacaagaccacagtggaattaaaattgaaaatgaactcccaaaggaagcctcaaaactatgcaaatacatgaaaattaaataatctgcttttgaatgattcttgggttaacaatgaaatcaagatggaaattttaaaaacttttgaaatgaatgaaaatagtgacaaaacatattaaacctctgggatacagcaaaagtggtggtaagaggaaagttcatagagttaaatgcctacatcaaaacatctaaaagagtgcaaacagacagcctaaattcacacctcaaggaactgaagaaataagaacacactaaagccaaagcaggcagaagaatagaaataacaaaaatcagaacagaattaaattaaattgaaacaaaaaagtgtaaaagataaatgaaacaaaaagctggttctttgaaaagataagcaaaatttatagactattaatgagatttaccaagaaaaagagaaaaatcaaataagctctattagaaatgaaattgggacccccacattgaccagaatccgtggacgtggtgaaccaggttatcaagtacaagcctgcagttgcctggcagactggaaagcctctctccatagaggagatagaggtggcacccccaaaggctaatgaagttcgaatcacaatcattgccactgtggtttgccacaccgacacctataccctgagtggagctgatcctaagggttgttttccagtgatcttgggacatgaagttgcttggaattgtggaaagcgttggcgaggaagttactaagctgaagctgagcttcttccatgctccactaaaccatttcttgcatcacagtggagagtcgaagaattccatctcttggaatcactttcaagcagatgtctagcttggattcagccaatgggattcaataaagagagatttaaaagtcagaagaaaacaagaattccagtacagctgtagcaagatgcgcaggcatttggcagacatgacgttggcagcagcatccaagtgagttcctgtgaatcacccgctttgagaattcaagcaactagtgccattgcaggtggctttctcacattcttgaatttttagatctctgaggctagttaacaatctctttgacatatacaaatgcaactttacaagggagaaaaaagcatccaattctctgcattgattttttttcctactcaaaataaattcttagaatgctt

SEQ ID NO: 909 - DNA, 1855 bp, Homo sapiens
gctgagactgaaacagaggggctgggacatggtaggaggaacaggacaccacaacccctcaccctgcactcacagctctagggcagaatggagcctcaaccctgggtgtttatgctgtgagctgaagtttaagcaaaacaaaaatagagaacttaggtggggttggggtgggggtagaacccgccaacacgaaacgtcatcgtggtacaagtggccttttctcattgctatttacatccccgggtgtttctatcagcccagagccagagactcaccacagagcaacctgttgccagaatgctgtgggggctgcgctattttaggagcaaagttttcccaggtggctatattgtctgcatttttctcaccagggtaggacaattcatagagccactaaagccaaccacagtgttgaactctgctctaattttaaaatgtaaatgagcaagcaccaatgggaagtggccaggagcagaccagggcaatcagctcccaggggagccccaagcgtcaactcccaggtagggggtaagggtgaggcctgctgggtggggagtggactaatacagagggctgggaaagaaatgtgtgtgtctaaaagcaatttgcattaggcctttcagagcccaagtctgtgggttggcttgcacaatcttgcaatcttacaagcaagagaggaagaaaggagagaggggagccaggggagaagggtgtggggatcagacaggcttttgtatgtgatcttgtttaagcaagactcttatcaaagagtaatcctaaactttgcgctttcttatcacccagctccctggggaatgggtaggtgacttttgagttccacaagggaggattaattgcctgttagagatcagagctccaagtaagcagataaggttgatagaggtgggtggggtgtggtggtttacttatgtcccgtggagatgttctttgctcttattatctagattcacgttttctgtgcacaagccgaacactgagggctgaggagaaagctgccgtctagtgaacagggcagcattggagggtgtgcctgctctgtgccccatgctgcagatgctgagcaggggttgggatatcaaagaatgaaggaatgagccatgctgcactgttcaagaaggtccagttctgtggtggttgtgtgaatacaggacattcttttctttcttttttcttttttttagactgggtctcattctgtcacccaggctagagcgcagtggcaagatcctcaggcttccataacaactgtgaaagtactgactgagtagttaagttaaatattaaaagctgaaagggccagtgcccttatacaaagactggaatgtaacaaaagcccaccaagagttttgcctaggcctttcctgggccttaaagcgtgacaaaataatggaggaattcttaacaggatccatttaggattaaacaaattttattgggggtctgaagagactccccaggcctccacagacaagtttattggggtcctgaaggaactccccaaacgtctgtgatttagcaggagacaagagtaatcagctgggcacagtggctcatgcctgtaatcccagcactttgggaggctgaggcgggtggatcatctgggtggatcacctgaggtcaggagtttgggaccagcctggccaacatggtgaaaccccgtctctactaaaaatgcaaaaactaactgggcgtgctggtgcacacctgtagtcccagctactcggcaggctgaggtgggaggatcacctgggcctggaaggtcaagactgcagtgagctgtgatcgtgccactgcactccaacctgagtgacggcaagacacggtctccaaaaat

SEQ ID NO: 910 - DNA, 2525 bp, Homo sapiens
gaggtgggaagtgtggccggattgtacagaaacataatggatatgataaaaggattgcatttctgagaagagaaaatgactttattgcttcatcttgaattgctaagtattgatcttgttttgttttcctaaagcagcaattcagtgcagggtggtttgataaaaaggtaaaacattagtagaatagcctttcatgtttatcagttcctttttttaaaaaatcagcagcatggtttaatgctttttctgtcaggctttctctatctgtttattgctgatttgacagtctttggtccttctcctttgctgttaaatgtgtgtgttctttgtttgtgctggtgggttttgctacagttggatgtgagagaaaagcctgtctttgccatattggtctaattagcctttgggtgagcatatacattaaatagaccttctgagctatgaaagaagagagctcacaacgtagattttcttcctgtactggggttttgcctgttttatttcctccccggattgatggccgaaagcttgttcggaatgcttcatttggaggatacaatgaactttctccttcattgccaggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcg

SEQ ID NO: 911 - DNA, 1917 bp, Homo sapiens
tttccctaaagaatggcccttgtggataagcgctaagtcaagagacagtgattggacagaatttgtgaggaattcgcccccagatcatgaaagtcaccctgaaccccgcctcgtggtggctctgctggatggacgggactgcactgtggacatgcccatcctgaaggacctggccacctggccttctgtgaggctcagtccatgcaggagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggttgcagttcgagccaaggcctttgcaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggtggacgagaaagcctgagcacacatcctcaaggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaataaaccagcaagaaattcatcctgagctcagtggtgctacctacagatatctgccaggcatggtgggcgtggctccaggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcaaagaatgccggaaggtaattattcagatatacttgggaacagtgaaaaatagataatctaagagaaaaagaatctgacggcctttttagctgattccggacatatgcatcattgttgttgcagtgttaaaacaagagctagaaaactgacaatgtcgtctgcttacggaagctctgaaagactagggtgtgatttattaacgaccaacttctatcattgtgtgttaagtttttcatctgtgcatcaaatcacaaagaataaatagaacttttccctttatcagtcccttaggcacagcaggtcctgaacaccctgcttatatgttgcatcagcagttcagatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgc

(The sequence listing continues in the following parts.)

What is claimed is:

1. An isolated polynucleotide selected from the group consisting of the following:
   (a) a polynucleotide comprising nucleotide sequence of SEQ ID NO: 397, positions 184 to 1569; and
   (b) a polynucleotide encoding a polypeptide comprising the amino acid sequence of SEQ ID NO 2367.

2. A vector comprising the polynucleotide of claim 1.

3. An isolated transformant carrying the polynucleotide of claim 1 or the vector of claim 2.

4. A isolated transformant carrying the polynucleotide of claim 1 or the vector of claim 2 in an expressible manner.

* * * * *